United States Patent 10,407,724 (METHODS AND COMPOSITIONS FOR SCREENING AND TREATING DEVELOPMENTAL DISORDERS) - sequence listing, part 5

SEQ ID NO: 93 - DNA, 3437234 bp, Homo sapiens (residues 1-1,718,617 of 3,437,234)
aactgaatgctaacctgaaatcatgaacagtaaaagcagatggtcaattaaggtcttgaggaaagttgtgcaaccagggaatgaacatatttcttcatgatattcccagaggaaggttgcatttataccctgaattaggaagattccacgtgtgttctactgaccctgccatgctactgctatggtgtgtgcagctgaaaattactctgtcaatgattgccaggttaaagacaagaaagaggatcagttataactggactttgcctagggtgcaatttcttagtttgcttatttttttttacatacttcttatccaatttgtaggctaattttttcttcccttggattgtgattttagaccattttaataattttaaataaatataaataacagtaacagtatctctaccataaagcagaataagacaaaaaagaatatgtttaggattaatgtttaaagtcactggtggaaaaaaatgctggttggaatagtttagaaacatatttaagtttaattatacaagttataattatttccagttatttatctaattgatggtcctgattagaaatatatcaataaatcaaatatttattcaatttgacaaaaagtgctttagaattgaacagcaacaccttggtgtatagaaattcatttaaaactagtatttttacacaatgttttgcctcttctgatattaaattcttttgaggcacaaaaagaagccataccgagcggttggtgcagacaggcgtgaatgcattggtcccacaggtgaataaccggtcgccacccaccagaagcacccggatgtagttctgacattcctcctgagggaaaataaataaattaattaaaaatatatatatatatgtataatgataaacatgctaacaaagtctgagcacaagaagaatggtgagaaggaatacattttatctaataaatatgtaagccattaataaaatgtaaaccattaaaacaacaaataaacctttcagatattgaccaaaaaataacaacagagctattaaacaatttgatttttatcaaataaatttaattgctgtatctgcaccttgtttgataaaaaatatgaagataaatacatgttcaattaaattctcaaagcatgcatctaattttgacagaaatgatttcattttgaattgtatctgatagtagcacaaatgctaaatggccttggacgggtattaggaaaataaataaaaggaacctattagatgtcgctcgggaagcagtgccttggaaaacttcctcagactttgagaaaatgctgcaagcgctttttgatcagaaggtcacatgagaaactctgtacacaaactggagcaaattttactttatgggatccaactgcatattttaaatacaaagcaagtatctatatgaatttttttttttttttttgagacggagtctcgctctgtcgcccaggctggagtgccgtggtgcaaattcggctcactgcaagctctgcctcccaggttcatgccattctcctgcctcagcctcccgagtagctgggactacaggtgcccgccaccacgcccggccaattttttgtatttttagtagagacagggtttcaccatgttagtcaggatggtcttgatctcttgacctcgtgatctacctgcctcggcctcccaaagtgctgggattacaggcgtgagccgccacgcccggcctgtataggcatttttaattcattgattgaaaagtgaaaatatgcttaatgaggacaagatgttcgaaacatttgggacaaaaccctaggctgagggatactccaagaatggagtactttttgtggttgcaaagtgttcttagaaaaccctgggtatggtcatagcagtgatggacatgtgagctggagagctcctcacttattcagcaagcattcactgagtagctcctctttggtagccactgggttagaagtctcaatccaggctcctggcagaaaaatacaggatcatgacaattaccacagagctgtccatgcactgtaatgaggacacacagaggaatagcatattacgtagctccaaaggaacagggaagggaagaggtgtagagaggcttcctgaaggagctgacaactaagtgttaaataaagtgtaaggtttagtgaggcttcctggagggggtgcttgtaggacacctgttggactttactgagcaaaggagggaaaagacactccactcaagaggagcagactgtgtcaaagtgtcgtggctagagaaagcatggcgctctcattgtgtacagaggagctcacatagaagccgaggagcctgaaacaggccaagtgtgcccaggtagtgagttcacatgttactctgaatgtgaaaggagccattacatgttttgactgcgtgaagtattgatgagctctcatgttttatcactgaagaagcactcagaaaccaatgtgcaggataagctgaagagagaagcctggagtcaggaagccaaggaggaagtcacttccataactcaggctcttgtcatttcatgcctagaccaaggtagtaggtgtgaaaggacaaagccagaatagtgagtcaattgcacgccatggcgaatgaatgacgcacgaggcatgaaagatgctgcatgataacatgatgatttgaatcacatcatgctggaaatcaggggaatctggatgtaatggtatagctcatcttctcttcaaccaaatggacccccactctagatgaaagtgttaatttcccataacccagtctactgcatagcatcgagacagcggaaatgcatagtgctaatttctgtattttctttactagagacagggttctgtcatgctgcccaggctggtctcgaactcctgggctcaaatgatcctcccaccttggcctctcaaagtgctgggattacaggtgcgagcaccactcctggctcagattggcttctaaatgtaaagtgaaataccaagggtggattatcctcctaacattattcctaacagtaatagtaaccacttatcattggaagctgaactgaggaagatggaaaacaaccacaaagacctaagtagacttcagaagaattaccaaatgctcgtaaacagtagacagtgaatctggtaactgagaaaggtacaccagaggtgggaggcttgtcttgttttgttctcttttgtttttattcctggggaagggtcaggagagttctaaagggaaagaacaaaacaaaagacttcaaagaaccacacagtacttccttcccaggctgaagagaacacaggagggccagggaagaaactagaggggtacgggagcctataaaggcaggcagagtgaggataaaagaaggaagccgatgcctgtcagaggagacccacaaagacatcttccagaacacagggctgagcaagctgatggacttaatggatgacacagacatattaatgacaccatcataaggactgggatggaaaattacaaacagaatagaagggtgaggttttgtttgttttttgatgctgcttttagaactcttttaaaagcaaggcaagatgtaataaaactttttcctttaaaaaaaaaaaaaaagcaagagcttgccccaaggtaaaccacaaacaacatgggcaagggtaatttgttccaggagaatcatctggattgaaaagatgtgatttcacagcagagttctacagccctggtgaagagaaagcaagggcctccagtcaattatggaaaggagaataaccaagatatcaaatatggtgtttacgttaatttcccaaaggaagaacaaagtgcaaataagactgtaggttgctttcttttgtttttgtttttgttttttgagacaagggttcactctgttgcccaggctggagtgcagtggcacaatcgtggttcactgcagcctcgaccacttgggctcaagtgatcctctcacctcagtctcccaagtagctcggattacacgtgtatgccaccacccctggctatttttttcttttttttttttttttttttttgtagggtcaaggactcattatgttgcccaggctggtctcgaattcctgggttcaagggatcctcctgccttgtcctcccaaagtgctgggattgcaggcatgagccacagtgccctgcaactataggttaacattcctgaagaccactctcaaggttgacgaagaaccagcatgttggtcagaatgtgtgataaccatggtaaccatggtgcagcagtgtgccagggaggggcagtgcaaacccagctggtagtgtaagaatatcagagaaaaagtaaatgaggaaagggacagaattatttcaattagggcagagaatgaaagagcacgttctgatcattaagaccacgtgagaatacatgaagacactggctctattattggcgatgagccacatccccatgtgtcactggtgttcttcgcagaacggagtgagtgtgtggaaaaaaaggaggaagatgtcagggatccagatgatcaggcaaggaggtctgtgcagaatttttataaaatgatggagggtggccccagccctatggaacccagaggagcctgtggcaatcaggagctaatgaaggagggtagtagtgtagttggccccagccttaactagaggtctgagttatcaccaataacagtaggtgtgctcattcactgagtcctacaggagcaacgagtggaggtgggtggtattcgagtttcttcttaactgtcaagagcataactcagtcacccaactggctaagggcatctcacgtacttcccgttcttactcccttaaaggcatcctcatgtttaattcacagattgtgaattccagatgtgaattccaaacaaattcatttaaaataataaatgttttgaaaagagagattgggacaagttcaactgaaacagaatgtgaaaacacagggaaaaaaaagaaagtagaagtatttagcttttgagcagaagataaatttgggaattggacagtcaatactgtgaataaaaggaaatgagtggctgggcacggtggttccatgcctgtaatcccagcactttggaacgccaaggcaggcagatcacctgaggtcaggagttcgagaccagcctggccaacatgaaaccccatgcctactaaaaatacaaaagttagccaagtgtggtaatgcatgcctgtaaccccagctactactcaagagactgaagtgggagaatttcttgaactcaggaggcggagcttacagtgagccaagatggcgccactgcactccagcctgagtacagagcaagactccatctcaaaaaaaaaaaaaaaaaaaaaaaaaaaatggaaatgagtaaccgttccaggctgtgtaataattagtctcctcttgatggtgttttcaaaactcaaattctcttgcagatccactggcaacgcactttgccaatctctgttacaaacgtggcctttccatgggttacctgaacttgcttgaagtactgcttggagtcacaatgtagaggtagagtcacaatgtagaagtccctttaggagattcttttaaaggtttctcttataaatcagcatacttaaatgtctatgattttccttttgtcatctaagaattttttcttctagcccatttctgtaacttgaaaataggtgaagaggatttaatgaattctgattttccaagaagtcacagtgcacatctccaaggcctctagcagcttgctgccacaaggcttctagggttgataatgagagtcatctatctacattttgatcacagcacttgaacattaaaatgacccatgtgggcctgtgatccacagacgtatcaacctgtccttgacttcaaggcaattgatagccgaggagcatggttgctgactcatagaaagggcttttacatggagactggccaatacccacttggtctcaaggacacaaggccccagccccagcagagaaaacatgttttagggctgttttcttaatgaattaattggttttgtcatatagcatttcatgatttttttttaaacaggtatgttctgtggatccctcaggtatctcttcagcaatacccagcccgtcgcccagcccactaattttagggaggaaaggtaagggttagaaggctacaggctttatgttaatcatagtgctcccagtgaaatcaatgtgtcctcttcataatgtgttatctttgtcagcatcaaagtgctgaagaagagcaatttacaggaattgcatgagcctttcaaagttgaacccacatcaacctaaatcatgattacctggtgactcttgcaaaaccatacctaaccaaatcagatgtatgtgtgtatgtgtgtgtgtataaaggttgtatctatataattgtatacatgtattacttgtgaatatatgcacatgcaaatcacagatgcaatatgtagagataaacactcatatacatatattacgtgctatgtaatgtacagtgtattgatatataaaatatactatactgtatatatgtacatactctattttcaactgagctgacttcatgggaaacctttttggatacctcaattaaaaaaaataaaattaggtgtgcataatctaattttaacctaatgttagtatttaacctaaagtaccctcaatttttaaagcaattacataaaataaaagcagggctacaatgtgtcccatgtattgattaactcacagctttcaaaatattggcacttaggtacaaaatgtcaagatccagccctacaccagcaggcacttaggtagtatggtgtcatgagtttcttctcctgttcactaggagtttacctctttaccagcataatttgacaacttggtaaacaggaccacaggatatgacagggagaacaatatacatagctctggattctaatcaaaaccctcccactaactagcaaaataattctaggaacttggtgtcaaaaatcctgaaatgagatcatgaacaaaaacttttgaaaatcacaaagtgtaatagaagcatacagcagctctttcattcccataataatcagctgtgtttcctttgtaaagttcctaaatgtcagagtgggaggaacgtcagttcagacattatagcccaacacacacaaggaactcttgttaggtcgtgagagaattgactatttgtgtttaaaataatatttgtgtaaaagatacttaagtagttatagaattcagtttctataatgctatgtccagaagaactaaatacaacaggttttattataagtttttgaatccataaaaacagattccccacccccactttttttcccccatggaatatttaagccattgcaggcaaaggcactccctctttcccaagggagctgaacattttctaaataaaatagaattcaaactttacaagggcttggcagcttcagtacctaccttcttttcaaacctggcccaaataaaaaatctggataacttctcttgaccctaattccctaaattgtacttttaatggattatatgtgaaatcatatctgtgtctggatacagacatcccagggaaacaaggggaaatccatcatctctactctcctccactctgcagcaagctgaggaatgctcccatcagaacagcaagtgggcacaggcagtgtcctccctgcacacccagccacctccttccatgcatgcattccagctcagctcagcagctaaatgcattatgtgcagaagcacagaccacttttctcagagtaggaaaaaaaaaaaacaacttcagtttaaattgctggcattcttctcatttttgagatgtcacattttgcattattctttttatttcagggagaagggaaactttgtaattctgttctcataagaacttcagcacaagcaaaactacaaaacagctgaattagccttctaagctcatgaccactaagaaaagtcttcattccattcacccaaagagacgttacctatcagtcaaattgactgtgagaatgttctctgaattggctcctaggaactgtcaaaatggggaaatgtgggttgtctgaattctgagttcagggggcagtccttcggaggctgcatttggtccagttgcccctgttcataggggctgccttgtttctttcccttctctgtcccaggagctgggcttggtcagccagcttggtcacatcatggtcattgttcagttactatgttaagaaagcaagagagatgccaaataagaaagaggaacttataaaggtgggtgaagagccctctcctctcaccacccatgaaccagcccagtgctgtctagaccaacatgtttgtaaagctactgcatcatttttgtacacaggaatttccaatgcacacagctctgctacataaactgagctgtacttcgaagcaacagaagttatttaaactgtctgtgaatttatcaatatacttaaggcaacctaaaagaacgtgtgatttatctttctcagagtacgtggtgcttgacactcatcttcatctgtcttactatattagtgttaaaaaatccattcacaaatgcggtttgagtcaattaataattactaagatttcccattatttttaatccattaaaacccaaagcatgtgaaacataaaggtttgattttacttgaaaatatttgtttccctcatttgctttctgtgtatcaagaaaattcaattaagtgtagtaacgattggtctcctccgtgaatcgagggtatattacctatcggtcccaaaagatggccttttcctaatacttctctgggttcaatttacttaagttctaagcaccaaacaaccaatgatcacggcttaaggcaaaacgtgggctagttcttcttcagcagaagcaatttttcaccccaagtagaaataatctattagcaaaaggcaaccacatagattctttgtaaattatggacttccagactatgaggaggaaaaacccctcgctacatgatggaatctgatgctttgctttagtaggacaaggagtataaggagactgaagctcataaaggggaagggagttaactgttaatttttaaacgtctttgtaacaaatatatacatgtaatcaagatgaaatatgagaggactctagggagcataaaaatcaaaataaacaatgcaaaagtgacaaataaatttgccattttggaaattaaagcagggattcccgaccaggtcaatgtctggcaatgtgtttcctgccatgtatggaatagctgccatgtcaaagcataatctggccccaaatatcaataatgatgaagatgagaaaccctaaattaaagttcactaccctggtatgggcttctcatgttcattcagtcattcagtggaacatctttaaacgctcaccgtgggctgggagtgttaagatcggacgaggaaatagcactgggacctgggagagggaaggagggtggggcccctcaggtctgggctatcagctaaacattttcagaacagacactgtgacaagtgtgcatcaacaatatctgctgctaggttgctcaaatctgaatagtgcttattgatgtgtccatgagacccagaaagaaagaaaaagaggagaggaaagagtcaaagtaccagaaggaagataaagacaagaagaaagagttgagaaaaagcaagagggagagctaggtcactgtattagtctgttctcacactgctaatacctgagactgggtaattttaaaggaaagaggcttaatggactcatagttccacatgactggggagtccacacaatcatagcagcaaatgaaggggaagcaagacacgtcttacatggcagcaggcaagagagcttgtgcaggggaactcccctttaaaaaccatcaggtcttgtgagacttattcagtatcatgagaatagcacagggaagccccacccccacaattcaattaccttcccccaggtctcttctagcacacatgggaattatggaagctataattcaagatggagtttggtggggacacagccaaaccatatcaggcatcacacagagcaacccctgggaggcattgatatccccaggcaaggcccacggcaggccttgagagcatggaacagtggtgcttgcatcagtgaatcttactagttgaaataaagaaagccatctttccacccctcacttcatgtaagtctgactccaggtcccatctcattccttggcacaggtggtcttatttaaaggactgtgctctgaccagtgaagtggggccgagggccgagccacacaacccccacattgagactcaaacaccacagggaggaaaaaggaaactatttagaaatcacctcttcaaaagtcctatacatcatttctacaaactcaacaagaaggttataggggtccccgatgtgtgggctttagattatttatttattttggggagcatttgaggatatcacattcgaattctttgacaattggagtacctttaaatctccttatatctctgatgatttaactcagaggccttttctgcggttaaatatcttccagaaaatacccttcatcaattcctgctttatttcccccttgtctccaagtgtttccctggctaagactgcattttcctccttctcttcttcctactcctttattcagggttgggaaaccccataactaagctggctgacacttgcctcagtgtctgactcccacagcgattcagttaaagggcagggaagcagacaatgaaattgggtaaaaaaaaggtacataacactcttttataaatacagaagggggaggatcttttgccagtgctctctgcatttgctatatttttttccccaaactattggtcctaggaccaactttgcatagcaagccctcttttctactctgtgtataactgctgtcttctgtaacccaaagcataattcaccattggaagtctgtgctccaatataaagtaagaagatcactaacagaataatacacagtgagcctgttcacaagctgcagaagaatttcctcaagttgatcatgaataattttctcaaagacacatagtcttcctggaaaggcaaagaatcacgcatctttttgagccagagaaacatttgaaagaagcctgcaacatgtacaattgctcaagaaacacatttccaaccttagctataaactgcacattctataggaacatgggatgtagattttcgtatgaaaagagagtttattataaagaatatgttaagataaagaatctatcacaaataatattttatgtaataaatttatttgtcatatcattactttctagatttagctgtaaagtaagaaaggaggaatttaaaatatcttaaaaattcaggcccatattttttccagcgctatcaatcaattaatttcttatcttagtctaatgacagaaagggcaaattagctctgatcttcttatgttctgaatcctttttggaaatgattgattgctggggttaattttaatttagtattaaaaacttgagaatataccgtatacatattttgaatcttgcttttttcactttacatggcaccgtaatcaggaatactcttcatatcaacatgctttatatagtgtagagtccttcaagacagggtgatggctgctcataattgcattcttcttacctttgatttgcctttgctgtaacaggcctttttggtagcttcatcacactcccattccacagcctgtagaaaacaccaaaacaatagcagtcatggttttgactaaataaaagggaaaatataaacaaggtaacaaggcactggtaaccagattaggaaatatggctgcatcctggcaccaacattttcatactcatagaatttacaccaaatacatgaaatttagtcatgggcttagatttagctctaatattgaagcataaggaccttcccccttactatttgcttttgggtagtaatgatgggatgcttagatctagtcactgttagaaaggaacaatgagttggtgactatagcactgatggtagaaatgatcacttcagtgaaactatggaatagacccagacgaggcttaagggagaggccttgagacaagataatttaaatattaattttaacatttttattttattcaaataatatgtcatttatcaatattcatagataatgaaggatgattttgcatatccttactaccaagatatacctgtaaatgataatcaatcaatagatagctcatgcaaagaacatagctaggatttttccccagtagcagtcattttcatactattattagctctgactaaatgtttagagccacagcttttaaatattttttctcagaatttccaaatctcacttatgctgattaatttgctatgtgtgcttccacgtctgatgctaactcacaaatgaaatgtgtgattagtgaagaaaacagacagggcttgctttacagaaaggatgcctacaggcatccatggcctagctctcgtgaatagttttttgcgcaaattgaggcacctgggctttttttttttctcttttctatcattgtatagagtgtgaacttttatagggtaaaaatatttttttcattctccatacctgttatcagaattattattttctattttactattaaaattggatttctgaaggaacagggatgtgcggtaattcaatcattaacagaaagacattttgagatagagacttttttctgttaatttggactaatgtcaaataataaactaaaccaaaagcaacctagtgtcaaatcatatgaaggaaaataatggcttcacccttattttttagtaagaaatgttttctttctaattatccaaacttgggagaataacaaagtcaggctaacaccattctctaatatcttctgccttccaaagaatgttacataacagagattaaatcatacaacactgcatcttgtataatttatgttacttggcaaatatgagtccataagaaaagtattctagaaagaaccacttcagtgtctttgaaaccaaaacaatgctataactgttttcccttgtgcagacttgaagatttttgtcagtgtcaacatctgataagagaatttgttaattccttctgtgctgtttccctgttcataatgtttgatggtaacaatacagtcatagctaatcagcatctgatgcaaacacatgatttgaattccataccaggatgacaaatattttcatgaaaagcaatgacacctccagagaaaacagcctcccatacagttgcataactatatccccatgaagtacagataaaataaatgaaaataaatgtgttgttgttcatctgatttgacctttagtatattcctttcttagatctctttacaaaatattactcagtttttttgtatttaagtagatatccacgtcttggcctttacttaaacttaaaacagtattgaggattgattaaaacagtattgaggactgaaagaatatgatatattctttcagcagagtaaaactcattataactttgattgtgtattgccagaggtttcagtattacatatcaccaagaggaactggtgttacacaattactaggaaaactatacagtgaaatactttagataaagagtcattcacggtggctttcattggtctagtgattttgttaaaagttaaataataatgttctcttctataaacatgaaagctataaagagaaggattagtcccagggctaaggaagaagaatatttaccaaatgccatcaaaattgttcagatcctgcggctgaaatggcaaacaaacagcttcacaagtctacctaatgcccaaatagcctttgcattttcaagataaatattggccaaagattgaaagggaaaataagagaagaaagaatgtgagagttttaaaaaatatttcattatttttatccagcataccaaaaaatagcaactgctcttacaagtttattagaccaataataaatatgacaaatcttacagattttctgaagatagtgattagaaagaaaaaaaattaatttcctaaggcattttattacagcctcactagcttgcctataatattcaaatccagaattaattaaagaccatgattgtacagcttttctgttcactttctacctgaatagagaacaggataaagggaaattttatattaagaatggaactttacttattccagaagacagcaggaatatatacatattattggatagcacagaatttgaaaaggaatagaatggagaaaagtggcttttccagattatactagaatgggatgctccagattcatcccatagtgtcctcctattcactaggtcagctagactttgcctatttcatcacttgacagacatgaaattaaaaaaaaaaatccatcagagacaaataagagtatcaatgtacctcctctctgtgggttcttatttctcacagtgacgcatttttctgtttgaaattaggctgtttgtttaacctggtcacaacttccttattcttctagatccattctaatgaaccaaatacctcttaatcaagccttctctttcatttctcagtgaaaatttttattatttcatgtatcatgattatagaacaagtctcactactgatttgagaagccacgtgtccacttgtattcaaaagatgtttttccactaacccaaacctatctttacaatagtcaaaacaagtgctaaagcattctacatttcagatctcaacccaacattcatagtctcatttcctgagtctcccttttaaaaatatttaatttttgtcatcttttgtctttttctatttcaggatagcccagtagagaaaagaaatatttctactctaggctattcaatattttgtctgcattatatatttcagcagcagacatatagcagtaatattgtggttacttgaatattcaaagattagatacagtaggcagtgagtttgaaacacctacattttaaaagacacaacgattcctgtttgcagtaagtttttttctgtaaatacatacaaataatacctgtactaaggaacaactcacagaagttttgctttatgcaaatacattaattatctcctttatttaacaaatattcattaagtacctaccaaacagaagacactcttctatgtgactgacagaaggaaaaacagacatagagatacacatcagatattaatttacaatacagcataagtgtattccatcagcctagacagaattatgttaaatctgaggagtcaacagtgttcattttcattgttatagtagccatatgcacgttaatctcaggtccagtgacacactctaacttataatatcattagctttcaggatgtgacaaacatacaaagagagctacaaaaaaaaaaaaaaaaaagaagaggcttatggaaaacccattttatatctgcataaatcctgggtatgcaacaaagcccccattgtttcaaggtacagcatccattggaccgtgttgcacacagacatactacggttaggataaatggagctgtgatctcaagagtaaatcagatagagaaaagaaaaagagattggctctttttatgtatgtgttacatacatataaatccacagttctcagaagtatataaacaaagctgtgtattatcacactccaccgccagataagttaattagatagggaccagcaaaggcagacacttcataaaaatgaagagaacaacattctaggcaaatgggctactactctttcagcagatggctttgctaattagatactggcaaaagataacattaaacaaaactagtttaattacacaacgccaaaaattaacaaccacctgagggctttcttttttcatatgtttacattcatattcttatgtcatgtattctgcgatgcgctgggaaatgttacattgccatggcaattataaacaaatcgtcagggtatgcaagactatatctttgttcaaaactgaaacaaatgcaaatgagttggaactagaaacaactgtgatttgacttgaataaaatgtcaacctataacagtaactttgagagaggacatctttgctaattataataccttcatggtcacacgtgtcagggtcacacaagtgtcacttgagctagaatggcgtgcattgaacgaaaaaaggcagtaaacatttcagtcaatttggaaggatttgttcgatgttcctctgcctttacttcctagtggatattcaatgtgtttgttattttttcacattaattttcagtatactttcatttccgtccatgtcaaatacaagcaagtacaattataacctcaaaatcaaaagactagccaaacatcttatgttctcactggtatgtgggagctaagctatgagtatgcaaaggcaaaagaatgatacactagactttgaggacttatggggaagagtgggagcggggcaaggcataaaagacaaccaacgtggtgcagtgtatactgctcgggcgatgggtgcaccaggatctcacaaatctccactgaagaacttactcatgtaaccacataccttctctaccccaataacatatgggaaaataaatttttttttaaatgatcaatttcaaaatttagaaattaacttaaaaaagactggaatcgcattagagtcatatcatcccactattttttgattctcatacactgccatcatctaaaattagaagaaatatcttaactttagaaatacctatgaaaatgtgttataataatttttaaagcccttatgctaatgcccaagattttctttcacataataacaccacattaaacttacattgataaggaactgcagagtggtgctcccagcctgttgaatgctcactgggcgttctgttctctaattgggagttgacaatgtattcattccctagagctgttgtgagaaactaccacaaaccaggtggctttaaggacagaaatttattcttacagttctggaggctcgttggcagggttgaatccgactgaaaactttgagggacaatctgtctgggcccctctcccagcccctggggtctgccgctgacctgtggtacgacttggcttacagggcatcactggaacctctgcctcactcatcgcatggtgttctccttgtgtttttctttgtccaaatgttcctcttcttataaggacaccggccactggattaaggcccactgtattccagcaatgagctcatcttaactaatgacatctagaaagactcttttttcaaataaggtcatattctgggaatctgcatggacatgagttttggggtgatactctacaacccagtacaaacagcatggcataagagatttggagaaacaattcatagtcacaaattagggtcattgctttgccacaaattagttgccaattctcaagcaaaataatggtaacaatttattaaatgtgtgatgtgctagctacagtgctaaatgctttctatacacttacctcgtttaatgtgagaggtactattataataagattttggatgaggacttagggtaaataacttgccaaaggccacagagtattaagtggcagccccaggattggcactttataacttggatctggagcctgttatctgaactactctcctgctatttaaattgccaaattaagtgccccttcttacctgatttttacagtttctttgttttccaccccgtaatttagaaaaatacatatctgaagcagagaaatttgtgcatgtctaagttcagagctgttggcattcagtaaatattaatcaaaaaagccattgattcccttgtcatagaatgtattcatgtctaaagcctctgggcccattcacagccctagaatcgattttaaaaggaccatgatttgcctaatgaaactctaaagtcaagaaaggtgcagccagggtatgatataagaatcttgggttggttttgtgaaattaaacatcttctgtataagaacacagtttgttcttgacacagcagcaatgtcctgctttcaaaattcagtctgaagacccatcacttctattaagccctaccggggcttcccacacctcctggattaagagccaaagtcatctagaaaattctgccatgtccaggtacttatttcctagtgcccccaccccattcttttacgggtggcatgggtttctcagcatggtctctgaacaaagcagacacattccctatggcctgtggacttactggccccactacctggaatactttcctccagatgcccacctagataatggctgtgcctcctacatacctttgttcaagtgtgagctcctcgctggaccctatgtagccatatatgtatatgtgaaactgccatttgcttcctcctttctcactagaaagcaaactgcacttgggcaggcagcttggctgcttggtacacgtctgtatctgcagcacctaggacagtgccacatacacaagcactcaatatctagctgttaaacaaattaacggatgtgttaatagaatgccctgcacccatgcccttggaagtcgctcaggtgtccttctagagaccccttgtagaatgggcacatgaggcttggcagcccttgagctggttgggtgagcctaccacgtgttgcacctctgtggcaaaaacatcccacaagaatttctcttccacacttcaatttgccctgacactgggaagaagaatatgaatgcatccgctctgggaagacagaaagggaaggatcagaacaaagattttactactttttcagcagtagacaacgtttttttaagtaacatcttcagcctaatctcaaacaaaaggagataaaagtggtatagtattccccttctctgcagttttacttcttgataccgcagtcaactgaagttcaaaaatatgaaatggaacattccagaaacaaacaattcctaagttttaaattgtggacaattctgagtagcatggtgaaatctcaagccaccctgctccatcctgcctgcggaaataaaggatccctttgtctggagtattcacatgtctatgttccctgcctattagtcacttaggagccctctcagttatcagatcaaaaaaacatagcacacacagtgttcagtactatcagaaggttcaggcattccctgggggtcttggaacctatcccccgtagataagagagggactaccatattatgtcaaagtcatgctttaagtgcaaaattatactaagtcattagaaaaatgtgagaccaagtgactgctgagtcataacaccctcggtatccaagcatttctgtattttgttttggttgcctgcttttgaaaaaaacacaaatttataaaaattaatagttataaataagaccactttgaatctcagtaaattggcagtacaaattgaaatgacagcggacaccttattccgtactctataataaaccagggaggccaagtaatgtcacagtaaaagttaatttactgagtgaaggattctaaagtcttaaaattctgtacatggtatacatttttggtataagtgtttcttaaataatgggattaaagcaatataatatctcaaatctcagaagcacctctagaatctgagggttctgagtaacacagttggcaagtcactattttaaggaaccaaatttatctgataagaaattttggggctggacctggggtcagacagagaaaaacaaagtgatggaagatgagttccaatgaccctactcctgaacacgaatgaaccctgctgggatgatcttttgaaagaagaacattagagagagagaagaaaaacagtatcaaggacattataatatctggtataaaatttaaaaccatgattgtcagaccttgaagcatcaaacgactggtgcacttcaaaaatatttctaaggtaaggctcataagagccttacttcttggttgcagggttttacagaaattattttcatgaatgcaagtaggattggtttaaaaaatggtgcatcgtcaaatttgcaagactaaatgtagcgaaaaaaatcaaatcactggagggatggctatttttatacatgaatttcctaaaagtattagtataaggaacccaattcaaagtcaatcaagcagggataaaagtattgacatcggagtggattgaattcccaaggactggcttgcctagtttaatatttcccaaatgcatttggtggaaaattgattgcatctaatgttatattttctctcttttacaacatacaattatatcttacatcacatggatgatgccatccaagtaccacaatatctgtatactgttcaacagaaatgtttgctagcaattagatatatcacaagcaaattagaattagatgttttatctgatgtaacatttattctgcatatgtagagatattccaaaaggaataagttgattatagaaagttatgaaaaatgtcacaccaaccgagcttagtaagactatctgaagattgtatgggacaccaatatgaattcacaagataaaattttaaacaatatgagaagcagcatgttagcatgggattctctgtaaaaccttgaccaacactaggaaaacacaacttgatataatgaagcctgccttgaaaatacttttacaaggctaagtttgtggtgtggctttgaccaaatctttctttcacacgccagttaactactgacaataatattctagcactattggtaaaagtgaagattaaccatcctgtccctaaaacaaaaagaaatttcacagttatatgccaaggtttcatctgggaatatagttaaagggttcaaaagggactgcatgtagcaagtaagaagaagtaccaatctttttattttgaggcaacatgaaacagatgtagaaaacgacgccagcaaccacagcatgaatgcaaatgaaggtgcagaaaccacgcaactctttgttgtttggcttagaattttattttactgatgtgaatgaaatatttttatattttcaagaggaatatcccatttgtgattttgtgtgttagatttctcttgcttaaaatgtaaagccacctatattggcatcattggtttgagtcctattattgtgtattctggccaaatcttaatgaagacattctgtatgaactgtcagcctaatagccaatattgatgtaaatatatggatgtttgctttcagtttctccataaatcttttctatttttctagtcttctgaaactggcttcatgaaaacaaacaacacttcatacctgattactttctctagagttctgggttaatatctatgcactagactcactggagcacttacaaaacccagattatgaatgtttcctggggaattgttttatactcatggaacaactcagaatttattcattattcaagttaaaaatgcttgcttcctgagatatatcctatcaaagtcaacaaagattgactttacttccagcttgagaacatattgatctattttccagatctcaagatatatgcaaaaccctccttatgaaccttattcagcattatttccataagcttttgttttcagctacaaaaaaatgaacacgaaaatttgttttctagtgtaagtttggtagtcattgtttactctcattttaaataaaatgtgtaacaggataatatactctgttcaagaaacacattatttactatattatcacaatggtaaatgagcacttagtgaacatgactgatacattcatgtcctagttaatattgaacactctcataacttaatgaatatctgcttaaacgtattaaatcaaataaataatttagcattaaacagcaattgtgtggttttgccatttatttctccaaacatttttctctcttctataatttgttcatttacatgccagagatgtcctaaaatattgtcattactattattaagatgtttgataagagctccatctaagaaaaaagtccaaaagcatttcaagtgtgagaataagagttggtgaatttttaatgtctgtaacatctgggatatgttgatggaaaattgatgccttttgttataattttacaacaaaatgaagagaacatgaggcactccttcccttccatctatttaaatcattccttttgttatgtgattagccagggttggcaactaattgccaaatgttacaacttcactcaatttcctactaaaggaatttgattttgaaataaattaattgcctacaccaattagggccttgaaacacaactttgtgtatatctgagggtggagcattggagtaggatgaacactggtcccttaaaagatatccatcatcatctctgcaacctgtgaagttaactcatacggcaaaaaaaaaaaagaaaaaagaaaaggactgaagataattaaattaaggatcttgagatggagacattaatctattattcagggagcatctcaacatcactgaaaacattctcatatgaagcaggcagaggaagatgcggagcatacagaggagaaggaaatatgaccgtggaggcagagatagtgatgaaggagcctcaagtcaaggaggccggcagccacccgaagccaaaagagaaaaagaacaaattatttcccccaaacttctggagaaagtgtggcccgggggacccctttattttagtcgcataagaattaatttggactcctagcctccagaactgtgagagaaaaaatttctgttgctctaacccaccaagttcatgataatttgtcacagcagccatacaaaactaatacatacatacatacacatgaattacacacatgaacacagtcacactcaagcgagtttaggagcatggggtggacatgttagtatctgtgtgtccatctaccaaacatctgggccaggcccattgtacgaaattggaacatgtcatcccaaaatatgcctttgtcatgggattattttgagctgattattttgagaaagcctagacacaggagaagctctgaaaacagagtagaaattgtgtttgtgtaaggtaagcttacatctataaaggaaatctctatttgtaagggtgtctcccctactgtaccaggaagagaaatatgatcctggtcaggagataagtcaatggagaagccactgacttaaatgtgcacaacaaaccttactccggctaaccatgccatttctggtcacgttgccattacttacctctcccacacacttctttctttaatctagctgaagatggtatttaagcttgaattctaagatatctctttgagagtgactcatttccctgggtatctcccgtgtgtgtaagacataaacatatttttataacttgtttttctattgttaatatgtcttttgttacaagggcccagctgagaatttagaagagtagagggaaaattatttcttcctgccctacaatatatatgaaagatgtagttgttgatataaaagacctcttaaggaaaacatgctgtgatcttgggcgtcttgaaggggaacactcaacccagatgtagggatctggagatggatgaaggaacatttcttagggaggtcaaggcttgagctggatcttgaagcaattgaccagtgagtgaataagtggaagagtagatgttcaagaaaagcaaatgaataagctggtgcaaaggcctgaaatgggaagaaaggacatctaagctggagaactggaccccagggtggggattggagaggtctctggctacacgctgatatgcagctcaggacaggcctcctgaaccatgctaaaagaagttagttcagatttatttttcatgagttgaagaaaagccatgaataaaattttaagcaagatattggcatggtgagagacaagtagttgagaaagacttctctgtgggtataagacctggaaagcagtgtggctgtagtggtgaatacaaggagagtgatgtagaggtcattgcaggcaaccagcaggtaggcattgggaacctgaaattagcagggacaatagggatagaagaagggatgggtaaccagcaatttagtagtgggaagggcactgtcttttgatcatgtagatgtgtgggtggacagcagtagcacaagtctgcctaatctacagtatgaaactaattcccacccattccttaagctgggtttggactgaatgccacacacaattctgaactgctttctttccacccccataagtaactttaaccttagacaaataaaactacctatacgatcctgtttaaagaaaacacaataagacagtaaatcttccaaaatagcaaagtagttcaagaaaaaagaccgaattcatacaatgttttgatcatcacacttttaaatcaaacacactttagttcattggtaatacattctggatttttaaaacaaatggaaaaccaaccaaagaaaatcttatgaatcacatgaaagttacctttaaaactgtaggaattcaaagtaattcagtacaagaacttctttttcaaagtaatacaataatgatttatttgtttggaattctgtgtcctaagtcaagcaaataagatataaaaaattacacaaacataaatttcaaaatgagagaaaacttacaactcttgacttccaagacatttagcaaagctaaagaagttggaatttaaaagtggaaaaacataagaaaaatagactaacaaattaagattttcatatctattagtattacatttttcttagattttcacatgctatggttttaatgctccaccaaaatttatgttgaaatttaattgctgttgtaagtattaagaggtaagacctttaggggacaactaggtcttgagagctctgtcctactaaatgggactaatgccattgtctcaggagtgggttagttataactggagtgggtttctgagaaaaggataaatttgggctagtgttctccctctgtctcatgagctttcttcatatgatgccttccatactaggatgactctagtcagaagctggcaccaaactcttggacctcacagcctccagaaccatgagtcaaataacctaatattttatataaattacccagcctatggtaatctaacagcagaaaaagtgctagacatcacatctgagaaaaattctgaaaagagccatgctattaaatgctgatattaattgtctccaacctagaagagggagggcatttcttccttaatcagccaactttagaattcacactaaagtttcagctgtactgtgtctcaattataattcacaatatcaacagcaaaaattcaatgctattttctaaaaatactttaggtatgactctgatttctcaagttttgactatgactatgagtcatgactaccaacatttagatcagcactatgagattaaccagaaccaatatgtaaatgtatacggcagaaagccatcaatcaatctggagtggacacaatgtttccaagtgtaactataatagaggagcaaagcaaaaacagaatcctggaatcagacaatgtgtgacagtacaacagcctaaaagagctgccggcaagacatattgggaaagttagtccaaaggagcacatccatgctcaagagataagaatgaatcaactcctgatggggaagatggctggtactcttctgcccatcataactaactctaccctcccaacaatctagggtataggtaccagtattacattcatcttacacagtaggtagaaaggagcttaacaacttgccaaagattactgagcttttaaatggatggcctgggattatgaagtcaggccaccctggctggctccagggtccacaatcttaacccacgtgcgatggactctttcagtgaatgagttggcaggatctcccagattcctaattccttcctgtctcaccagagttctattgacagattgagtttgtttgctttgaacttgtcagacaaaataaaatgtggtgcttttgaaaggcccttggtgggaaagcggggaatgaaatggtttggctggagagagaacactactccacatcttcactactgagatttcaacccagttgttatgatttcagtgctgatttcacaaagtcatcgattcgaaagcttcccccattcccaccctgtaatctgaactctgaaagtacatggaaaacacaaaagtaaacttaattgtgaatagtcttattattctgcaattttgtgtaattatccaaacccacttgaaataataacagaggtcaagacaaagaacatgcacggataaacatggatattgttccataacctgacacattatatgtgggttaagatctttacactatacaaagaaaattcaaactgggttatatttcctaagcgagtttatacgttgaattaggagaatacagcaaaaactatcccatggagacattatgcaaactggtaagcatggaggtcatcaagccttatgtactggagatggtaggacagatccatccattattcaagcacagccaagaaagtgcacttgaagttccaatctaagattctaagattccatattcttcctttatggtaaaagatgggttccaagtttcccatatggaatataatggccaagccctttcttatacagctcagagcagggacaccctggggaggtgtgaagaaccgtggaagagatgaagatgagggcctagtgcactcttgggctctcacccttttgcatgggctagctccctgctttctgacctgctccctaccagaacacagctcttcctcatccccagcctcactatccccctactctcctctaattggagtatccacctcattagagtctccttaaatggtctcagggctgacaataacacaacaatttatggaagagctaaacattcctccctatgctatcacacaggcaatgggtaagtactgcattttaaatttagtgctttctaggacaatcataccccaaaagagctctaatatgtctgaaacaagtaatgctaacagagttgtctgcctcatttcctaatgcttcaagctcttattaggctgaataattaagaaaactattttttcttctttgtttttccaagtatgataactttcttccatacatgtctatataagcttttactcaaggacagctgatttaatgggttgtgatgacggataattaagtctcttaattattctcttaggattattgtagctgtgaaaatcaagccacatacacatacattcaaacagcaattaaaaatattgaattgctttttaatttagaaattatttctggttttggaagctatctctggccccaatatgctcatcattatatttgcatattcaaagactttatcagtcttcataaccattttgattggtctacctcctatggtgttttgacaaatattattataatctgttagatttatgttcctactaatacactatccaggtgatttaacaaacatatagtgtttcgttatccaattttaatagaacctataaaaatacaaatgtaactagtccaaatgtggtacaaaatctcatcctttcaagaaacctgaatctggttattaccaaaataattccttcctgtgccatctacaccagcctctactttccctttaaataatgatgagcctcaagagaaagaaactcaacattaggaaggagcttctatattgcctttacatgaataacaaacaaaactattatagcatgatcatcctaagataaaacagttaactttgctcctccatgcctaacatcattaaggacattccttgaggttcagtaatgtttaatatcaatagattcacaacatacaaaatagaaatagaaacattatcaactatataaaatcacttgattggttctctaccaagaaaatgccacaaaacaggaagtgttaactctccagtaatattcctacatagtcagtggaacttgtaaatgtattcaactaatatttactgagcacctattatgtaacagaatttgggatataatatgagcttttctaaagcctgctgtattttagaaattcccagcctagtaaaggcaagagaaaaaaagtaattgtaatacaagttgagaagtaaaggtatatactgtaagaacacagagagaaaaacacgtttgtagagaagatggaggattacacagcgatgcccagcccagcagccacctgagcaggaatgaagggaagatagaagttcttgagagataagagagacgtatgcttgctgaaaacaggtaccaggatgtgcaaagtctgtgagaagtggaaaaacatctcacattcatgaaactgcaagaaatgtgtatggctgaatgccacaaggaatgttgaggaataagcagatcttgaagctggaaaaacaggaaaggtcagaccatggtgtttcatacaggatattgtttgaaaataggattttttttttaaatttaagagttttaagcagtaaggtaatgccatagtttacatatattaagccatgaaccacagtaggaggcaggaggaatggaggacacagagcattataaacaactgcccaaggccagaaagcaagtaaaggagctaagattcaaatgtgatcagatgcgcagtttagaaggatgacttgaggaaaaagggatagaatgtatgtgaggatagaatacaattaataaaagattagctagtttaagcccgtggtgataaggcaacgaggctgaattcaataagcttgaataaggctgaatgcactgtaagctgtagactagacagaacagtataagtacacatttagggaccatcaatgagaacggggaaccagcaaaggcatccattgctctggacaaaaggttatgaatctgatctctgaggtcagtttaaagagctccatccaaatgatgatagtatgaaaaactattctactgttcaggaaagaagttagtttggaggtaaagacaaaacattccttatcttgatttttgtatgtctttgcttgggaacaaaggagatacagtgatgtaagtgtggctcagatgttttgtttattttgactttgcttcttttgaggggaaaggaatggaacaagaagtcacctacaattgctcacacaatcatccatctgcatttgtcatagctggtcaacatgcagggtccacaccaaggtgctgaccacattatgggtatgattaaggatgaggaccctcatgtgaaatagctttgttgagcgtgagaaacaatgtgccctaacacaaagacatacggcttgatcaccatgaagtggggatcacaacaattcactacagctctttttcctaaagaacagaacaaagtatccattatagcatttgacaatctaagcattccttctgggaccaccttctgcccatggctcatcctgtccaggttttcttcctcatcactagctgctccttctcagtctcctttagcagactaagctgtgtttcctccaatggtggcatggccctggcatctgcttcggatccttcactttccactcttccttcctccttgggtaatattaccttgttttatgacagcaaacaccatcagtacaacacacctgcattcctgtccattactggaaagtattaattcttccacctctctcctgggtatattccttggcatatccaaaagcatctcaaacgtaatacatgtaaatcaccagccatgatttccctctctgcctcccaacttgcttctcccctagtgttgcccatacactacccacttagttgctctggtcaaaggtatacaagtcatccttgagtcttcttgtttcctcactgccaacatccaatccaccaacaaatcatgttgactggaactaacaaacaaaactttccaaatgcgtccatttctctaccagtaactcttgcctaaattctaatgcaatttcctaatggatgtccttcctataactttgtcccattataaccctttcctctatgactcacccaaaagtatctttttaataagaaaaatagatgatgtttaataccttcgagtggcttgccatttaggtacctaaaacacaattcaaagtcttgggcctggttcacaaagcttgaggtgtttctgcctccaattctctgaccccgtgtgtcaccattcctctactccttgagccctgtgatccagcaactctaaacctctgtaggttcctttagccttatccactgttccctcttccaaacctttgtattcactgagctctctttcccaaaggtgctttccctcacctgtgcctgactcctcaatattcagatattgactcaactgccactctataagagtagaccattctttgccaccctatctacaagaacttcataaatactttctatcacatcactgcatttgaattcttggcagcacacttaccagtttctaacacttttcctaactattaattgattaaatatctcctccaactataataacactgtaagagaagtccttcccttggttcaacactttatttcctgtacttggaagtctgactgccccataagagaccctgattaaatatgtgctgaaggaaggaataatctaggagtttgaaatgagtttacttttgcaaacttctgtctgaaggtaggaatttcaaggcgagagcctcatcacatttgtcatcaggtgaacctggttttaagagtataagttcaagattagcatgaagagtgaaaaaatcagtttgcatttagttttcaaattcatcttgcatatctatgtgatgtgaataataatctctgaccttcttggttcataaaattgttgtgagatttaatgagatagttacagaggcactgtataaactctcaggcaaagtaatttagtagaaatagttgggtctgtagtcttctgtctgcatcaccaactggagagcttattcatggcatggaggaatttgctggtacattgagtgagtgtggcttaactggggcggtgggagttgccacctggcccttgaagagttttgcatctggcaataatccagagaatgactccactgagaggtaataaacacagagaaaactctttacctatcatctctatgaccttctcacagcgtcttgtattggagacatttcaattgttccttggatggaaagtagctcaccttttactgtcagcaggacacatggtacatgtgccattacgttgggaaatggctgcacaactattctaagtggaaaagtaaagctctacacatctgtatactacccacatagatcttttttttttccattctacattaaatgtcactgaaagtagatcaaatgaagtgcaagctcccatgtcatcctggaaaatgtccatgaaaacagtcagcattaacacaaaatgtgtggtttatactagggactgagattctattttgctctaaaaaaaaaagactataatttctcctgacagatgaggtcagtgaataatgtttaaaatagatgacgtccccttacttcttacccttccccttggtcataaggcaccactagtggttcagaacccccagcattacaaccaccattacatgcatcaaggtggtggtcagggcttgcagatgttttattacaactctaccaaggggcatccatgggagggttcagcaaagcccaggaacagggtacacaggggtgtgcagggcaagtcagcccctagacagctctgtacccagtaactgaggcctcagaaggcagagagaagccaagtaaagggcaaggagggtgttagggtgttttgtttccttccttcgaggctatagatgataccactacaccctacaactagctgccagcacctagtgcaaacatgctgagattttgacctgctgaatacacatttggactgaatactgaaaagtcgctgagaagaaacacaagggggaagaactgtcaaatggcatggcatattactaacataaaaaaagaagcattcctgttgatttgaaaagaatatcaagagaagctagaagccttaccatcgccccttcaaataggttatcaaatgctagcttcagtcctaactctatattttcatgtaagttcttaaattaagaggctcagggaaccaaaattttactatgcaatgaacatcttggccattgggttacaaatgaattgatcaaacttactttgtcttgggattggatttaggttacctattgaagactggtagccaaccaggcgtgctgtctttcagtgaggtggcaagagaccacaggcctatctcattctgtcttctccactcgcaggctcaaatgccaaggcctcaatgcactggctctctctctctccttaagtgtacaagacaatggaagaagtcttgccctaatcacccttaggttatccaggggaacaaagagctgggctgaatcctggtgatgagatttactcaagtctttttatttccctatccctcatttttcctcattgcttgctggatataataaaaatagcaacctcaaagggtcttggtgagtattaaggagtgcttacaaatagcatttaatccagtgtctgcacatagtaagcctgtgatattgttaactacataattacttccactattatttgtcttttcttctttctttctttttttttttttttttttttttttccctgagatggagttttgctctatagcccaggctggagtgcaatgtcatgatctctgctcactggaacctctgcctcctgggttcaagcgttcaagcaattctcgtgcctcagcctcccaagtacctgcaaccacaggggcctgccaccatacctggctaattttgtatttttggtagaggtggggtttcaccatgttggcgaggttagtctggaactcctgacctcgggtgatctgcctgccttggcctcccaaagtgctgggattacaggcatgagccaccaggcccggccccattattttttacaaaaagcctttttaatcccattctaattcttttgctatctgcctttcacttggaaatacagctacaatggaagagagaaatgcaaactgcttctgggcaaaatttgcttttaatattctcaaaaggtttgtagtaccaaatttttccccacatgttcacttgaaattattcttcactttgggggagatttaaaaataaaattttagtttccatgtagttgagtggctttgagtgagattcttaatcctgagttctagtttgattgcactgtggtctgagagatagtttgttataatttctgttcttttacatttgctgaggagagctttacttccaactatgtggtcaatcttggaataggtgtggtgtggtgctgaaaaaaatgtatattctgttgatttggggtggagagttctgtagatgtctattaggtctgcttggtgcagagctgagttcaattcctgggtatccttgttgactttctgtctccctgctcctgaatgactactgggtacataacgaaatgaaggcagaaataaagatgttctttgaaaccaatgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggatacattcctcgacatatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcgtcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattggtgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggcattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggaactcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctgcaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacatttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaactcttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaactggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagattataataaaaaaaaaaaattaaaaaaaaaaagaaaatatatttcttataaaataaaatattttcgaaaaaataaaaataaaaataaaattttaaataaatgcctaaggaattccaaatgatttggcaagctaaatccattctgtcaatagaaaaaaaaaaaaagatacagatgtctctgccaacaaaaaatcggttcagaatattaggttgtttattgcaatatttgtatttgaagaaacccacaatggttctgtgcattaagaatttttgagaatttgttatcattgaaagaaagaaaaattcccattccccattcttttttactccgtcctccaggtcatctaagtcaggggtccccaacacccaagccacggactggtcctggtccatggcctgttaggaaccaggccgcacagcatgaggtgagcagcagacaagtgagcgttactgcctgagttcctctgcctgtcagatcagcagtggcattagattctcttaggagcatgagccctattgtgaactgcgcactgcagtgagggatctaggttatctactctttatgggactctagtgcctgataatctgaggtggaacagtttcatcccaaaatcaacacccaccctttccccactgccccaatgctcgtggaaaaattgtcttccacgaaactggtctctggtgtcaagaagactggggaccactgatctaagtcgttagaactcttgtattctaccattcaacctttacctatgacatgaatttaggttcttgcaaaagaaagagaacataggttttcatgcctgtgattaaatgcctatgatctgtactttgccatgtgattccatggtgggaggcaagttatcctcatcgatcacatttagagtttaaccacatgagctactctaaagaagatgttctcatggctgagttttccctgtgtctcttgggtatttctcaatgtgcactgcatttagaaataaatctcaaagtgctctgatgacgtatcttttctcaaacacacattcccctcatctctccccatctcccctgcagaaattgataagaagtgaatttctctagaaaatctagttttgttgttgccattaaactaattttaggattggaaactcacatatatggtcactatgtgcctaccttctttttaggaaacatgagtctgtgatgaaagatataagtgaatccaaattcaagtttaattttggaaaccatatggtaagataagaagagaataaaacatagccttcaaatagatcacattagttttcatttagacctattatttactatttaagaacattttacatttgccaaatacatttctataagccaagaagaaccaaatttttagagctagaataaagacagaaaaaagcaggagcccagaaggaggaaaagaaaggaaaaagaaggccaggaaggtgagggaaagtgggaatagtcaaaggaaagaggatggcaaggacaaagaggaagtgaaaaaaacattaaaccatctaggctccaagtaaataacgcattttatttcaatatgtcaaagcaaatcctagaataacgtaccaggcacttgaaattaaaatacagccatatgctccgggaatgattttacaaagaaatgaaggcagaactgatgtcagctgaaccacttgagaagaaaatgccctacagttctcagcttcggggttccaggttgctgggggtgtggcattctcatagtgacacctcccaccctgaggtcatagtgacacctcccaccctgaggtcaccagcgggttaatgttcagtttgcccttggtagatcctggcaaccaggaatggcaacataaaaaaggaagcacatctctgttttataattttatgtatcatatttgaggacaaaaatatatctttccaagtaaaatgaatctagttcttaagtaacaacaacattcatcactctcaaaagtgtgaggggctggctgacttcggggtgggaagaaacatggggcgagggtgcagtggggaagaatcaagtttctttacctactaagtacattatcccttgtttcaaaccccaaagacgtgaacagagattgactttgatctgaaattccttctaatcttactttgggagccttcattataatgcacatgcatttaggaataaaagttagggaaaattcttactatgtggattgaatgactgaaactgtgagtgaatggtctgttgtggatgaaataaggacattccccatagccccaaaccaccgcgagacattttggtgtgagagtaaaattcagctccacggtcgtgtgctagctcagcatctgggaggaaccaggagggtctccaacggcctaattacatattcccctcctgaggctcctcttgtggatgaggtgctctagacaaataacctccttattagaaggacaggcccagttcctgcctatccatgaggtgtgggcttcagctccctaccagaccatataatttatctaacaagtcaatcccatccttctatggaaaccacaggcatcctaccttccttccactgtaaggcctgcctcccacagccctgtgatgttcaactcttctgccgcgggactcccatgtggctttgtgtggtgtgtgcggtcctcctgctccaggctgtgagtatatgtgactcataaactgctgctgatctcatctgtccagtgcctggcgtcccatgttcagctatccccataactctagggcaagggatccctccctcacgaataagacaaacaaaaggaaattaaaacaagcaacttctgaggtctgctaaaccaagttcaagtgagctgtccacttagcgtctgtttaggccactgcaaggctgctttctccctaccctgcaagtctgggttccagacacaggattcagcaagccctggctggctctccagcaggcgctcttgagaatgttaagggctcagcaggcacaccgtgttttcatgttcagggcctggcatctgaaaaatgctaggcggagaagggcagtgttttgcggaggaagaccaaagagtaattgctacatttcaacattccttgccccacggctgccctgcttccaaatctctcccacattttctcccacttaccgcgaaaaaatccatttatctcacatttcccaatctgtttgtgaacaaaaggcatccgtcctcaatgccgcactgtatgagctccaaatactgctggtgctacgtctgccttgagggcattttaggagagcagggaatggttcgagtctctgaatacaggttgatgtttccaaaggagagaacagtctatccatggttctgtgttttagtttgatatatcagataacacaagatgccagagttatccagggcacattttaaagcacaagtgagcttctgtgctaagtatcttataaatagagtcttctggcaaacttctgcttttaaatactattattaatgagaatgaatggaaataaatgatctggagggtttcctgttattcgtgacaatctttagagggccatggctccttaaatgacgagatactacacattttaaaagtctctatcaatctaatgataaaatgctaagttgaatacaccattattatttaatgtaatttcaggctaaattagaaacttttatctggtcccgtaagatagtgttagaaaacaatattttatcttctaagcaacttcttctcaccctcatgagaaagaatgtaggaagattatagcaatgaaataattataactattctcttttgatgggacaaagtaagcatgattaacttatttatcctacagtaataaaggtaacttgtccagctcagaaagcccatgaaactctagccaacttgtggccagaccctgtgtaactcactactgaaccccaagttcagactgctgaataaatcaatacaaactcaactttaccaaagcagtatcaatatggaaagttcagcaagctctggatattggaagagtaaatatgaacacctaatacaaaatacctaactaggtacaaaatgaaggagagagattttaagtatgcacctaatttaattctcagaagactcccttaaaatcccattgtacagattagaagcctgagattcagtgaagacgtgatataccttacagagctctgcccagctagaaagtagcagaatcaaggtggatttctaggttgctggctcaaaaccttcgaacagctctctgagtccacattgcaaacagcaggatgaggctcttacctgatgttcacattcagaaaagattagattcttatttaatatatgagccaggaagaatttcagctgagaagcccgccacactttgcaggcttctgggtttggaaaaactcacaacataaaatctcatctgaatctcctgtactttgcctctatatcgcgctatcaagctgttgcccgatccacttgaaaactctgctgagctgaaaccatcaattccttgtgacagttcattgaatctttggtccactttactttaggaagttcttccttaaactgagtgacatcaatcaccccataccttgtactctttagttctgggtctatgccttaatgacacagagataaattcttaactggtttccacattattgtgcttttcttatttacagaccctgaaatcttcctcctgggtcttctagaccagtgtttctgaaagagagtattccttctctcatttctcagataaaaggcatctgattcctctgactgccctggtctctttcttcactcttctttctgattagctagacctcaaaagtatagaattcaactaaaatagttaaagataaaaagacacatctgagatcgacttcagaatcatctctggccggggtgggcatgggcgaagtggataaggaaagagatgagaaaagatttacagaacacgtggataactttttaaattggcagctgggtacaaagggttttattatactattctctttacctttgtctatgattgaaatttttcatgataaaaagcttttttcaaaagtgtagcatgcaaaaacatgcatatgacaggatctgttagaggaagctaagttatcacatcctgtatcataataatataaattgagtaataaaaatatgattaaaaatttgagccatgtaaatatgctaatttgtgccttctgaaacacctatagtattggttatacctatagtagttggttcttgttgttcttgtaggtagtgcatttagcacaattgtagggcttcttatttgcccttgaaaattttttattggtagatttcatctgttaagaatctatggaccctaaagctgtcaatcagctgattcacttgggatgatcctcaaatatttttaacacatcgataaaaatacagagacaggctgagtttagaaacctagagaatcaacttccaagacattttctgtgtgtggaagatgtgcacagctagcagttcagtctggaaggatgactgaacaaacagtgataagaccacccattcactgaggaaaacacagaaaacggcgtcatgagactcccagggaaggaaatgtaaagcttactttttatccttttttggcaacacagttcagaatttttcagtaaatagtaatgtgatagcactgatctggaatttgaataaagctaaattatgatggaactaaaaatgccatcttaataaatactactgcccccaggccataagagttgatacagaggtaggaaatattgaatccataagtgagcaaaagataattagatgttaataaagaatttattttccccgcactgtggcaaatttcatttacatcacacttcataaataatcaccttcaacacttcaacagattgctgtaatttatcataaatttttaaaatgctaccttgtatatatataattaatcagcaccaactgcttgaatttgtaattgcttaataatttggggataaattattatctgtgttttaaacatactaatttatttttaaagtaagtatatttctatttgttttagaaatgatgacaatttccagatcaagagctaggaaggcatacaacatttacatcgtacaattaccttctggatgctaaggacaaaacacatttttgtttctccaggttgcaagatctataggctgatagaaatgcatccctctgcaacaacacacagcacatgtggtgggggaatgaactgagagaaaatccgcgggatggagactgggagcctcatgcctctaatttgtcatcacgctgaatcatccaacatcctcacctacaacaaattactgagactagcaccctgcttactcccttccccagctctgtgagagacaccttggcgccagatggcaggcaggagatggccaggcagataatacaggatctcctgtaggcatggaagcagtagaaatagatattaataataatcacctattgtgttggagctgtgacttgtatctgactcagtagaaagacaatggagatggctatggaattcctaaaaagtacaagaacagtatttgtgttctggcttggttttgattagctatgcaaccttgagcaaatggcctcacctgtctaagttagcgtactcacttgaaaatatggggagaaaataataaatgccctaattaccaaaaaatggtgaggtagagcttgaaggagataatgttcatgaaaatattcttgttaacactaaaatagaatagaaacattgtaattacaactgctgttgtaagagtagcaaaagagacataaaatataaaatgtaagattatacatggtggtgaccttaaggcttctataaatttttataaaatatctatttatattctctatgtctatatacatagtatgaaatgtaataaatctgcatatgcaaaacataagaattagttctaacactcacttctgagttaggaagccagtgttattaaattccgtatgacaatgaactccatccagtcccctttttacagctgcacagagaagacttagtagagtaggcctgagactgtcatcctagaagggcctgcttgcaaaattggccccttagctggtttctgggagctcagatatcaggagggtttccacaattccctgttaaaaacggctcactgtgcctcaattattaatacatgcaaggtggtttacgcaagcatctgctttccttccaggagtctgcaattttaatacattccaggcagagaggtcctgtgtgatctgcccgcaggagaaacccagggcattgagcctctctggtagacaacactctcctcgtgttgtcacaatttgctgatggaaggattaagtgcatccagtgtgattccactggaagaagactcttggaagatcacaccttgttttcttcatgatctatccatgcacctcttgtctttgctaatttttttttccttcactgtaataaatcacagccatgcatgactacatattgagtccttgagtcccggagaattattgaacctggggtgatctacgagaacctcaattcaatagcattacaaatctatatggaaatgacaattttcagagatagatgacccaaaacttgagcaagtcccataggaaacaataacaactctttctagattctggccagaaaaggaagtatgaaaggtactgagagcgggggaaagtcgagtctggttggaaacacagcattcactttgggagcacattctcaggttgcctgagaactgactagagatgcttccaatatacctagaaagcagcagcccagatttggcatactctgatgttggggcagcgggtgggggcagggggaggagggtttccccaggacaaggttaaggagctttgctttacctggaacttctggtcaaaaaagaaaaaaaaatagattaaatataagccataatgttattgagatctaagaggcagacttctccaatgtacatcagagtagcaaactacagcctgtgggtcaaatccagcccattgcctattttctgatcacttgcttgctaaaaataggttttatattttcacatattgaagaaagaatttgtgaatgtttgctttctcctttttaacataaggaacttgatacggttttgttctctgtccccacccaaatctcacgttaaattgtaacctccacatatcggggaggggcctggtgggaggtctttggatcatagtgacagatttcccccatgctgttctcctgatagtgactgaattctcatgagatctgatggtttaaaagcatgtggcactcccccgtttacttgctctctcttctgctcctccatggtaaaacgtgcttgcttaccctttgccttccaccataattgtaagtttcctgaggcctccaggccatgcttcctgttaagcctgtgaaactgtgagtccattaaatctcttttcttcataaattacccattctcaggtagttctttatagcactatgagaatgaactaataaagaaaattggtaacaggagtgaggtacggctataaacataactgaaaatgtgaaagcgactttggaactgagtaacagttaggggctagaacagtttggagggcacagaagaagataggaaaatgtggaaaaatttagaacttgctagagacttactgaatggtttttgaccaaaaggctgatagtaataaaaacaaagaaggggactgctggcaagatggcagaataggaactgcagctcccagcaagatcaatgcagaaggtgggtgatttctgctttcccaactgaggtacctagtgcatctcattgggacttgttggacagtgggtgcaacccaaggagggcaagccaaagcagggtggggcatcacttcacccgggaagcacaatgggtcagggaactccctctagccaagggaagccattagggattgtaccatgcactccggcccagatactgcacttttctcacgctcttcacaacccacagaccaggagattccctccagtgcccacactaccaggaccctggggttccagcacaaaactgggcggctgtttgagcagataccaagctagccacaggagttgttttttcataccccagtggcacctggagcaccagcgagacagaatcattcactcccctggaaagggggctgaagcctgggagccaagtggtctggcttggcaggtttcaaccccacagagctcagcaacctaagatctactggctggaaattttcactgctagcacagctgtctgagctagatgtgggacgctggagcttggtgggggtgtaggggagtgtctgccattgcttaggcttgagtaggtggttttaccctcacagtgtaaacaaagccactgggaagttcgaactgagtggagcccaccaccgcagctcagcaaggccactgaagccagaccatctctcctctctgggcagggcatctctgaaaaacatgcagcagccccagtcagggacttatagataaaacccccacctccctgggacagagcacctgggggaaggggaggtttttggcagagcttcagcaggctgaaacatccctgcctgatggctctgaagagaacagagatctcccagcacagcatttgagctctgataagggacagactgcctccttaagtgggtccctgatcccggtgtatcgtgaatgtgagacacctcccagtaggggccgacagacacctcatacaggagagctctggctggcatctggtgggtgcccctgtgggacaaagcttccagaggaaggaacaggcagcaatctttgctattctgcagccttcgctggtgatacccaggcaaacagggtctggagtggacctccagcaaactccaacacgcctgcagaagaggggcctgaatgttagaaggaacactaacaaacaaaggaatggtatcaacatcaaccaaaaggatgcccactcagagacaccagccaaaggtcactgacttcaaagaccaaaggtagataaatccacgaagatgggggaaaccagtgcaaaaatactaaaaattccaaaaaccagaatgcctcttctccaaaggttcacaactcctcaccagcaagggaacaaaactggacggagaatgagtttgatgaattgacagaagtaggcttcagaaggtgggtaataacaaactcctctaaggtaaaggagcatgttctaacccaatgcaaggaagctaagaaccttgaaaaaagttcttgaaagttagagaagaacataaatgatctgatggagctgaaaaacacagcaagagaaattcgtgaagcatacacaagtatcaatagctgaatcaattaagcagaagaaaggatatcagagattgaagatcaactcaatgaaataaaggtgaagacaagattagagaaaaaagaagtgaaaagaaatgaacaaagcccccaagaaatatgggactatgtgaaaagactaaatctatgtttgattgggctaccttaaagtgacaaggagaatgaaatcaagttggaaaacactctgcaggatattatctaggagaacttccccaacctagcaaggcaggccaacattcaaattcaggaaatacagagaacaccacaaagatactcctcgaaaagagcaaccccaagacacataaatgtcagattcaccaaggtcaaaatgaaggaaaaaatattaaaggcagccaagagagaaaggtcaggttacccacaaagggaatcccatcagactaacagcagatctcgcagcagaaactctacaagccagaaggagtgggggccaatattcaacattcataaagaaaagaattttcaacccagaatttcatatccagccaaactaagcttcataagtgaatgagaaataaaatcctttacagacaagcaaatgctgagagattttgtcaccaccaggcctgccctacaagagctcctgaaggaagcactaaacatggaaaggaacaaccagtaccagccactgcaaaaacataccaaattgtaaagaccattgatgctatgaagaaacggcctcaactaacgggcaaaataaccagctagcatcataatgacaggatcaaattcacacataacaatattaaccttaaatgtaaatgggttaaatgccccaattaaaagacaaagactggcaaattggataaagagtcaagacccatcggtgtgctgtattcaggagacccatctcatgtgcaaagacacacataggctcaaaataaagggatggaggaaaatttaccaagcaaatggacagcaaaaataaagcaggggttgcaatgctagtctctgataaaaacagactttaaaccaataaagatcaaaagagacaaggacattacataatagtaaagggatcaatgcaacaagaaaagctaattatcctaaatatatatacatgcaatacaggagcacccagattcataaagcaagttcttagagacctacaaagagacttagactcctacacgatagtgggatattttaacaccccacagtcaatattagatcaatgagacagaaaattaccaaggatatccaggacttgaactcagctctggaccaagtggacctaatagacatctacagaactctccacaccaaatcaacagaatatacattattttcagcaccatatcacacttattctaaaattgaccacgtaagtggatgtaaaacactcctcagcaaatgcaaaagaatggaaatcataaaaaactgtctctcagaccacagtgcaatcaaattagaactcaggattaagaaacgcactcaaaaccacacaactacatggaaagtgaacaacctgctcctgaatgaccactgggtaaataacgaaatgatggcagaaataaagatgttctttgaaaccaatgagaacaaagacacaatgtaccagaatctctgggacacatttaaagcagtgggtagagggaaatttatggcactaaatgcccaaaagagaaagcaggaaagatctaaaatcaacacacttacatcaaaattaatagaactagagaagcaagagcaaacacattcaaaagccagcagaaggcaagaaataactaagatcagagcagagctgaaggagacagacacatgaaaacccctcaaaaaaatcaatgaatccaggagctggtttattgaaaagatcaacaaaatagatagacttctagccagactaataaagaaaaaaagagagaagaatcaagtagatgcaataaaaaatgataaagggtatatcactaccgatcccacagaaatgcaaactaccatcagaaaatattataatcacctctactcaaataaactagaaaatctagaagaaatggaaaagttcctggacacatacaccctcccaagactaaaccaggaagaagtcgaatccttgagtagaccaataacaagttctaaaattgaggcagcaattaataacctaccaaccaaaaaaagtccgggaccagatggactcccagcctaattataccaaaggtacaaagagaagctggtaccattccttctaaaactattcaaaacaatagaaaaagagggaatcctccctaactcatttcatgaggccagcatcatcctaataccaaaacctgcagagacacaataaaaaaaaaggaaaatttcaggccaatatccctgatgatcatcgatgtgaaaatcctcaataaaatactggcaaaccaaatccagcagcacatcaaaaagcttgtccaccacaatcaagtcagcttcatcccagggatgcagtctggttcaacatacacaaatcagtcaaggtaatccatcacataaacaaaaccaatgagaaaaaacacatgattatctcaatagatacagaaaaggccttcaacaaaattcaacaatgttcatgctaaaaactttcaataaactaggtattgatggaacatatctcaaataataagagctatttatgacaaacccacagccaacatcatactgaatgggcgaaaaactggcacaagacagggatgccctctctcaccactccaactcaacataatattggaagttctggccagggcaatcaggcaagagaaagaaataaaggttattcaattaggaaaacaggaagtcaaattgtctctgtttgcagatgatatgattgcatatttagaaaatcccatcatctcagcccaaaatctccttaagctgataagcaacttcagcaaagtctcaggatacaaaatcaatgtgcaaaaatcacaagcattcctatacaccaataacagacaaacagagagccacatcatgagtgaactcccattcacaattgctacaaagaataaaatacctaggaatacaacttacaatggatgtgaagggcctcttcaaggggaacaacaaaccactgctcaaggaaataagagaggacacaaacaaatggaaaaacattccatgctcatggataggaagaatcaatattgtgaaaatggccatactgcccaaagtaatttatagatttaaagctattcccatcaagctaccattgactttcctcacagaattggaaaaatctactttaaatttcatatggaaccaaaaaagagcccacataaccaagacaatcctaagcaaaaagaacaaagctggaggcaacactggagttacctgaattcaaactataatacaaggctacagtaaaacagtatggtactggtaccaaaacacatatatatataccaatggaacagaacaaaggcctcagaaatatcaccacacatttacaaccatctgatctttgacaaacctgccaacaacaaacaatggggaaaggattccctctttaataaatggtgttgggaaaactggctagccatgtgcagaaaactgaaactggatcccttccttacaccttatacaaaaattaacccaacatatattaaacacttaaacataagacctaaaaccataaaaaccctagaagaaaacctaggcaataccatgcaggacataggcatgggcaaagacttcatgactaaaacaccaaaagcaatggcaacaaaagccaaaagagacaaatgggatctaattaaactaaagagcttctgcacagcaaaagaaactatcatcagagtgaacaggcaacccaaagaaagggagaaaatttttgcaatctatccatctgacaaagggctaatttccagaatctacaaagaactcaaacaaatttacacggaaaaaaacaaacaaccccatcaaaaagtgggcaaaggatatgaacagacacttctcaaaagaagacatttatgccaccaacaaacatatgaaaaaaatgctcatcatcactggccattagagtaatgcaaatcaaaaccacaatgagataacatgtcatgccagttagaatggtgatcattaaaaagtcaggaaacaacagatgctggagaggatgttgagaaataggaatgcttttacactgttggtgagagtgtaaattagttcaacaatggtggaggacagtgtggcaattcctgaaggatctagaactagaaataccatttgacccagcaatctcatcactgggtatatagccaaaggattataaatcattctactataaagacacatgcacacatatatttattgtggcactgttcacaatagcaaagacttggaacctactcaaatgcccatcaatgatagactggataaagaaaatgtggcacatatacaccatggaatactatgaagccatataaaaggatgagttcctgtcctgtacagggacatggatgatgctggaaaccatcattctcagtaaactaacacaagaacagaaaaccaaacaccacatgttctcactcataagtgggagttgaacaatgagaacacatggacacagggaggggaatatcacgcactgtcaggggggtgcggggctaggggagggatagcattaggagaaattcctaatgtagatgataggttgatgggtgcagcaaaccaccgtggcacgtgtatatgtatgtaacagacttgcatgttccgcacatgtaccccagaacttaaagtataataataaaaaagaacacatctagtagagacagtattgacttatcaatagacccagaaaaaatgtttaaattaaattttggagatgtgtttattttactttatcagtagttttaaaatcagccgtatttactaaatgttattaaagtcatgtaaacttaaaaaaaaaaaaaaagaagtcccagctgatgaggtctcagctggtaatgaggaacatactgggaagtggagtgatggcaacccttgctatgcttaagcaaagagactggtgacattttgttcctgccctagagatctgtggaactttgaacttgagagagattacttagggtatctggtggaagacatttctaagcagcaaagcattcaagaggtgatctgattgtttctaaaagtgtatgttcatatgcatgaacaaagagattatctgaaattggaacttaaaaggaaagcaaagcataaaagtttggaaaatttgcagtatggccatgtcgtagaaaagaaaaacccattttctggggagaaaaatcaagcctgctgcagaaatgtgcataagtaaagaacagctaaatgttaatcaccaaggcaatggggaatatatctccagagcatttcagagaccttcagggaagccctctcatcacaggcctgcaggtctaggagggaaaaatggttttgtgggcgaggcccagggccctgctgctctgtgcagcctcagaacacagtgccctgtatcacacatgccccagctccagctatggctaaaggggccaaggtacagctcaggctgaggcttcagagggtgcaagccccaagcctcagtagcatctacgtggtgctgggcctgcaggtgcacagaaggtgagagttgaggtttgggaacctccacctagatttcagaagatgtatgtaaacaccttgatgtccaggcagaagtctgctgcaggggtggacccctcatggggaacctacagtagggcagtgcagagtgggaatgtggggttggagccccagtatggactccccattggaacactgcctagtggagctggcagaagagggccaccatcctccagaccgtagaattatagatccaccaacaacttgcactgtgtgtctggaaaacccacaggaactcaacgccagcccatgaaagcagccaaggggcgtgtaccctgcaaagccacaggggcagagctgccaaaggccttgggagtccagcccttgtgttagtgtggcctggatgcaagacatagagtcaaaggagattattttggagctttaagattgaatgatggccctgctgggttttggacttgcatgggacctctagaccctttgttttggccaatttctcccatttgggatgtgaatatttgcccaatgcctgtacccctactgtttcttggaagtaactaacttggtgttgattttacaggatcataggtggaagggacttggcttgtgtcagatgtgactttggacctggatttttgagttaatgctagaatgagataagagtatgggggattgttgggaagccctgattgttttggaaatgtgaaaaggacataagatttgggaggggctggggcagaatgatatggcttagctctgtgtcccacccaaacttcatgttgaattataatccctgcatgtcagtggaggggcctagtggaaggtgattggatcacaggggcagatttcccccttgctgttctcatgatagtgagtgagttctcatgagatctgatggtttaacaacatgtggcacttcccccttgactctccctctctctctctctcctgcccaccatggaaagacatgcttgctttccctttgccttttgccatgattgtaagtttcctgaggcctccaagccatgcttcctgttaagcccatggaactatgagtcaattaaacctcttttcttcataaattacccagcctcagtctcaggtagttcttgacagcagtgtaataactgactaatatcaacttgcatatgaccattttgtcactggctaaaatattaactatccagccctttccaagaaagaggtgactgaaccctgatgcagaatgatgagtgtctgagggacaggattttagagcaatttcttttaacatgtattttttcttggaggaattccatcctaggagtaggaaaaaaataccgatgtcaaaagcaaatctaataccagggctttgtacactgacagatccaggatccctaattacagattctgatttttactttacatttactgcagcagatatctctgtattcaacagattccatttgttaataaatggaccaatcactacaaaaagcacatgatccctattgatcttgtcaatgaataatagaaaagtaaagaaaagaaaggcaaagatgaaagtgggaaaggtccttcaagaccacctgagcagcatcattcttcacaggtgagaaagtgaagcacatctggacacaggacttggcccaggtcacacagcccttgcagaaccaggactccctcagcctgaccccgtgttagtgcctatgtccctcaacaggaccagggttactattcataggagaagctctcacttggccagcctcaaattatatcaaggatgacaatctaaaaatgacatttgaagtccagtttcctacattaaaaatatgcagtgttcaatacttcagttattttggtacataggcaaattggatacctctgaaattaacagaaacaagaatttgaaaaaccaaccaaaatttttacatggaggactctcaagttaaccaggcttgctaagatgagaacatcactgacaacagcaatactcacccaattgtcttcctcagacctggaaggaaattgttccaattatgaataaaatgtaacgttttagcaaataacaataaataattgtatgtgtatgtgtatctgtgtgtatacaatttaaataattcctccgttaatttaacccaattcttcattaataatattagcatgaattaagaacttctaggcttgagaaaaaccactttaaaagtctcatttaagcttcataataaccctatgagttacaaaccattatcattcttactttatagatgagaaaccaaatatatttatattactgaattaagatgagttatcagaatttcatttctaatatttaatgatcctggtaggatggaaaatacacaaaaatgatacatcagttactgtactttgataatgtatctttacttctataggaataaaatttccattttccctctagcacagaatttttctcttctataatgtaaataccttcacttcatgcaaatacctaattcaatccagccaagaactcccatccaaaatgttttccctataatttttgtatatatttataacagtggtccccaaatagggatagttttgcccccccaggggacattcagcagtgtctggagacagctgggaagggtttgctactggcgtctagtggatagagtccaggatgctgctaaatgtcctatgctgcccagggcagcctacacaacagtgaattatctagcgtaaaaagtcaactgtgccaagacggagaaaccctagtttatatgaaaagcaaatcccatatccatattattttattgattatctcttgacttatggactaacagggttcttcagggacaatgagaattatctggattcttatagacccccagatcaccaaatagggtaaggcaaatcgggtaaggcaaatcatacaaactgattaacaggaaccaagagatactgctgtccaagaccggggagaagacggcatgctgtgactaatggacatcagtcaataatttcataacctctttgggatacaggcactttttttttttttttttttgagacagagccttgctctgtcacccaggctggagtgcagtggtgcaatcttggctcactgcaacctctgctgcctgggttctgcctcagcctgtcacgtagctgggattacaggcacttgccaccacgcccagctaatttttgtatttttagtagagacagggttttaccatcttggccaggctggtcttgaactcctgacctcgtgatccacccatcagagcctcctaaagtgctgggattacagacgtgagccaccgtgcccagcccaggcaccttttaagtaaagcgagagacagttcagtcctcgtttccttccacctttaacacaagagcatcatggcagattagttcaaatcttggagcaaaaatatgaaggccaaacacttaaaaaatgaataaaaataaaattacaaaaacacaccaaatagaagaaagcaaaatttaaaacaaatgaagcaaagaggaagttgattggaaagacatgaggccaaaactgattcaagcggtgagtcctgtgaacatgggtatgggccacatatttgtctctgcggttttcagtaatgaaagagaagaggatgtgggatttctaaaggcagaatcctggaaaagcaataacttgcccattcctaaaactttcaaccaatgtaatgcacatgtacaaaatgacacactcctctctgaaaaatgaatattaaggaaaatgagcattatatgacgtatatttatacctaaatcctaaatactttttctagaaaataagaaaaaaacagtataatctcagaggttcacggaggcatcatgcactttctggcagttgtagctgaccagacggataaagggacccccaaacagccgcctcccgtgtcatcagattgctctaaaatacgtaattccatcttctcacatgtgcacctccccatcccacagcatcaatcctaaattcctagtggtaggcaaagtagagtcccactttctaatccttaaaacctgtgaccatgttatgcttcatggcaagggggaaagtttagattgctggcagaatgaaggctgttaatcgattgagccatgacaatcaggtagcttgtagaagctggaaaaggcaaggaacctgactctccatagaagagcctccaagagggaaccagacctgccaacaccctggcctaagcacagtaagaccaattttgaacttctggcatccaaaacggtaagataatcaatgtgcattgttttaagccactgagtataggataatttgttgcagcagtatcacaaaactgatacaactcgttttagtttccttttgctgtctaataaattgccataaacctagagccctgaagcaatacctatgaattatctctcagttctcatgagtcaggagtccattcgtggtttaaccagatcctctgtttagaagctcattgtcctgacactgagatgtctttttaggcttgtgagagtcttctaaactcattggttgctggaaaaattcagttctttgtgactgtaggactgagacctcttgatactagggaatgcccacccctgtctgccctgtggttctctccacaacatggaattttgcttcttcaaagacaacagaagggcacctgctgtggcccttttaaagacttgcctgttaggtcaaatccactcaggatgatctcccttttgactaacctatactcaactgattagggttcttaattccatctgtaaaatccccttactcttaccatataaggtaaattaattatggtcctgctcacattcaaggggaggggatgatatagggtaggtccaccagggggcagaatcctggggccatcttagaattccacctaccacactccttggctgggcaaagtagctactgtaccagtttgcctctgcccgttaatttttaaccaaatgccccaacacaggcaagttagtaaggtttgtccactgtcctggacatgttcagtattagatacatagaacatatgcaaatgctagcatgttcctctctctccagtgactgttcccaaacttcaccttattttcatgattgcaggacataacacagaacccgaggtacatggacttaatcactgtacatctccacgcatgtgatacatggtcttactaaaaaatagatagatagatagatagataacagataataggcagatgatagataacagatgataaataaatatcaaatgatagataacagatgatagatgatagataacaggtaatagatagatagatattagagagagagagagagagagagagagataagagatagatgctgtctgtgccaaatttttttcttgattgaatactctaattccaaattaggagattgcttgatcaatttccctgccaatcattcctccacaggtaggcaatcaagggttccaaatgaaagcatatcataatgaatatctaacacagtagcaatttgcagtagactataaaacagtagctaatacagaattctgagagaaactaatagtgacaaggagaaagcaaaagaccttcagtttcataatgtaaactcaaactcagatttgcttgcctgaaaagtatcaatgtaggcacatcctgaatgaattatgtagagaaggcaaccgtttgggagttaacaatgagccagcatataaggaaagatggcaacataattacttccattccttttctataatggattgggctgattcaaattcaacatatttcatcaattttttttttaacaatcacaagtgatggtatttttccctttatttgctaactcagtaattcttttggggggtaaaattttgaggaaatcacaaatgaaacaaaatccctgatcatgggctaatgcagacctaagatgtttttgtataaaattaagaacagccttcgtatttcttcttgcagtttttagctggaagaagcctaccagcacaaaaaggataagctttaataaatagctctccttgtgataatgtagcacacattgcttcaattatagttctattctagtactgggggagggaaggatccgtcctggcagccagaaccctgcccaagaaaatgtgatgataacacaggaagggggcacccccttagccagccagataaactctaccagtctgaggcagacttcccagcaagaaaattctcacatcctcctattctaataatagaaccaaactagaggaagggaggaagaaacatctgtagttgtgtgctaaattcctcaagcctcctacactttttgagtcccctccctttaattagaagcatttatgcgtcattccacagtctctttttccttccaactatcgtctagtatgtcttctactctacaaatgatttctaacatttcttgttacaaaatgttcctgtgtggaaaatgctaatatttcatgatgcaactgacccaactccacagtgcagtgtaggattctgcaaacaccatcttgttattctccgtaaatatccccctttccttcttctggagaaaatctcaagcttcaatcactgggccgtgaacccgccaagacagtggcctttgagtcagtttgaaagaacaaaaatgcctagagcccttcctccccaaagaaacatgggattgacaagaaactctttagtctctcaacatactaacatacaaattaaacacattgtttaacacaaactatacttgccccattaaaactatcagtcaaaagactcagaactagccaggcttggttcttctccaagccagacttaaacaccagctcacaagttcccacaacatctgtttctagatgcttgatctatctccctgccaatcattcctccacaggcaggcaaaggtgccttttgaagcttcaaggactgatctcaggagcataggatggagaacacactctcaaggagatgaaaagcccttttcaagccatgagggtgacctcctataatgaccttgacccaaatgttctggtgatggctgcttcatggggagcaaaaggaatactgtcttaataataatttattgtctatttcaaaatacgcagaaaaatagatttataatgtttctgacacaaagtaatgataaatggttgaggtgatgcataccccaattagccagatttgatcattatatattgtatatgcttgtatcaaaatactgcatgtgttccatacataggtacaactataatatatccataaaacttttttttaaaaggatgcttcctgaaaaactgaggcaaactgcactaagtgatatttatatctttgtataacgctgcagaatgctaggagttcgttccaccatattgactaaatatacttgctaagataaggtgtaacgattccatctttaacattataataaaaagaaacacccgggagacttcttatgagcctctatttgataatatgccatgtgtattatatatagttgggttacttttaactgattttaacaacataaaggcaaattttcaagtaattgcaatgttttaataagctaatttttaaaatttatattatatgaacttttttcctaccattgattttttcccccagactctgacacccctccgtactcttttttctatctcccggaccatattaataaggttcagcaatcattgtttgctgattgagtttgacttcccatgtaatgctttgggcaacggatatttgcatgcagagaaatgtggtcctctccttggctcaccacctcactgccaggaaactaccccttcaagagctgactgaccagggctggacagttaactcactcctccagtccaaataatatgttccttattcatatgtttttattcaatcattcattcatattttcataatctctctctcccttacacacacttatacacacatacacacacacacacacacgtgaatttttataattaagtatataaagactgaaaaatggcaaattcatcttggcaaatacccaaagtaaagcccatcagcagagaataagaaacactgagtgataagatagctgagagtcccctgagatcttggccttgggccgggctccttctgcaccttggaccagaactggctttggactcttcaatctttgaacacatttccttttttagttgcaggcaaaacaatcataagcaaatgctgtccgtcactgttttcctacatgtacccaatgcattgagggagataacatacactcctggggtggccaggaatgcagaggaccagaagcgaatgggtcaattagccactaaccctcccccgtccacctgcacttcctccagagacataggcaagtgtgcacttgagcacaagtacatgcacacatgtgtacgatggatacagacattcatctttatattaacccaggcagcagcatgatccgaaaaatgccatctatattaacatcatcagctagggttaattgaatatctgttaagtaactttggtgtcagcaaaagtatcaaattctatttttagacatcacataatacaatagatattattcagtttaagcagaatagacactacatcctttcatatatacataattcctaaagctgagtatttctttgtacattgcaattatttttagaggaacgtaactaaaacttttccctaaatatgatttaaataataatttaaatgtcaaaaatattttaatcttatccattgcaagaatttataatttataaacctttaaaaattatattcttctgaaataaattatatcaattttctaatgttatgttaccctagtacaggacttggcaaactatagtcagcaggccaaatcaggcctaccacctattattataaataaagttttattaaaactcagccatccatattcatatacttattgtctatagccggctttgtaccatcatggcagagttgatgagccataccagagatcacgtggcctgcaaagtctctgcatttactatctggccctgtacagaaaatgtttgcaaagtcttgctctagccaattatggcaaagtaacttaaaaattatttccctcaagccctaatttttaaaaaataaaatgtcatcatgttcaaccaaactcaatagattctgaatatccttccagatattctgaatattctgaataccagaatagtagattctgaatattgctgtcttcaaaaacacttatggattaagaggataagcaagcaaatgtataagataaatgtaaaagagacacatgacatatctaaaatagaattaaaagcacttcacaaaactgggaaaatattaaaatatgttttaggatactttatgaatcaagggttctataggaattacgtgacaccatcacataagataatttgaagaaggcttgacaagacaactatcaacaaagacacaggtgtggaagaggcaaacacaagagttcccagtggctactaaggggcccaaaggaatgctgggggataaagggtcataaagggagagccaggtgggtgtggctgctgcggtgtgaggccagggccacagccagtcccaggtaacccagtggcagccagtggtgggaatcgcagctcggacttccctcccctttctcccacaggccttccaaggaccttttccatggccctatccagctggccgcgagagggcacaggggcatgacagcagtcatagaagcttcccagtacagaggcagaaacagacgctgggaggggcaagagaaaatagccagcaggagttcactttctttcgaagatgataaaacaggagaaaataaatgtgaaactgttctctacagtgtttatatttctagccaagaacactctcatgaatgaaattcattttctaaaattagggcaatgctaagaataagtcttttctccaacattaaaataaaaataaatttaccaaaaaatggttgcataatgaagtggctggaaccaaaatgtagtcttggtaagattaagcccacagtagctaatgtacaagttgtaaactatatctcattcatatcatgttgatatttgaaagaagtagaaatgaggacacacaaaaaaaaggaaagcatttttacctcatccttcaaacaaaaacaaaagtattttttctcccaaaatgatttttaaattaaatgcttcttttgtcagaaagtgaatcctagcgtagtgacattgccattgatggtttaagcctattagagacctgtgttgctcacgaaacatgttgaataggactctaacagtattttcacaaatgtttttctcccacatcctcatcaatgagatctggcatttacttccaatcagtgtatatgtcttcatttatatattataaacacatacagctgtgcatgtatataagtatattttaaatacagtatacacatctgaaaataatgacatcaagataaaatgattgatattataaagtaaatattatgttatagtctgatttaacaaaactttttaaacttagtgcaataatttatgatagaatgaattaaaattctgttttctacattcaatttatattaatttttagtttaaaaacttctataactgaagtggacaactcaaacagatatataaatccaatttcttgggaggctgaggcagatcgcgaggtcaggagattgagaacatcctggctgacacggtgaaaccccgtctctacaaaaaatacaaaaaattagccaggcgtggtggcacgtgccggtagtcccagcaattcaggaggctgaggcaggagaatcacttgaacccaggaggtggaggttacagtgagacgagattgcgccactgcattccagcctgggtgacagagcaagactgtctcaaaaataaaaaaaaaaaaatccaattacatcattggctgtttttaataaattttgatatactactttttcaacttcatctgccaattagacaatgttttttgttgaaatttgccaagcacattttcatcttcactgatgtcaatatcttgtgctcaaaaatttatcagaaagattaaaaaatgagcttaaagtccactgaaacttcccttttgggagttttaaaaaagggttaaaagtacacataagacatttcaaaagtgaattttctaaatttatatatttaaaaatcaggtaagattgttattatagtgattgttgagcatcatcattaacaaccaattcacataaggacagaaatcttctgaggtatctgatttaaaaattacttttaatttttttatttcaataggttttttggaaacaggtggtgtttggttatatgaataagttttttcgtggtgatttctgagattttgggggcacctatcacccaagcaggctacactgtacccaatgtgtagtcttttatccctcaccccctcccaccctttcctcttagtcctcaaagtccattgtatcgttcttatgcctttgaataattatagttaagcactcccattatgagtgagaacatatgatgtttggttttccattcctgagttacttcacttagaataatggtttccaggtccatgcagcttgctgtaaatgccattatttcattcatttttatgatatacatatatatacactacattttctttatctacttgttgactgatgggcatttggattggttcaatatttttgcagttgagtattgtgctgctatattgcatgagtttcttttggaaagcaattacggtctcattaattgtgaaacaagacaatttcttttctacaggtacctactattcatcatactattaaaaataacaggaagttcagcaaatttagatcccttatatcttaaaaaaggagaaataggtacatagagatgatagcgctagatatacagaaacattgatatatgtgtatatacatacacatccattgacgttaagcttcacaatttttcaatatcttaaattaatgacagctctttaaatatgttgccactaggtatccagagaccctccctataaaacagaaaataatggttctttcccacctcatttcaaaacattataaatactctcccatgttaaataacataacacaaaaatgcactttactggaacttgtaagtcaaaacccttccaatatttccctgattccctcaggatgccttagaaactcactttggcatgtgtcagagcttgacatattgagcaagtgaggcaccagcatcaacttacattttaatattagtacattttacattgctgtggtataaacattctagaaacagaatttcccattttctttccatccgtctcttgagatcactgctattgactctagactacctgcttcagaatcacatttagatgtttgctaaaaatggtcgttcttggccactggagtcagaatcaatgagaagtggagtcacaaaacccagagtttaaacaagttctggatgcggcagattttgcacttcgcggatggtcccagcagcatgtcccccacaggctctcctgcatgcaacctgctggtcatccatccacaactggagtctatttctctaccaccttggattctggaaagcctaactcctttgaccaataaaatatgaccgaagagctcctttgccagttccaggcatggccttaactggcctggaagcttcatttccagtctcttgaaggcaggtgccatgtaagaagttcagccatccagagaccaccatgttaggagagaataaagagatgacatggtgggcaaaatgacaaatggagaagaaaggaggatgtagaagcaggaaagagagagagagagagaaagagagagagagagagaaaggagacagagacagataccaaggagcaatggcatgcagtccctgtgagtggatcaaccaccttgaatatggaacctccagtccaagcagcctcatctgatgccaacacaatcataaacaaacttctcagccaagttctttttttttttttttttgacttttggaattttggaattttggaattcctgatcaacaaaattgtgagcaaaataaaacggttgttttaaatcactatgttttgtggtgctgattaggtagcaattaataactgaaacaagaagtcattattttgctacaagtaaggatgtctagtcaagattctctccctgcccatcccaagtctccatacaggaagccccattcccctacctgggatttgcggtgaggctgcagccctagaaagatggctggctgtcacccctgcctcaggagtcctcgaggctacttttggtcaacactataactgaagcagaagcaacagtggcgtttagaagatgtcaaacatggaaataatgacttcttggacttatacaagtatttaaccctcctttccctttgttgaatgcctgacatcccacgtttgtaaatcaattctgtgaatcctccagcccatttatggtccataacttaaattgcatcaaataatttcaaacacggtagttaccagtatatacttgatttataaaattcacagttataacaatatgttaactcgtttactcaatctaaaaccttaaggaaaacattactattattcctgagagggaactgaaatacagtgagattaagtaacttgcccgaggacacacacccagtaagttgaggcagtggctactcagatcatatatccccaaaccctcttcattactgtcttcagttattaatacagaaattgtagttaggatgtcaggtaaataaatggtgaatttccataaaccaaagggaatttacagaaatattaactattctaaaattctttccaagtttaaacaatcaattttcatggtgatttattcaataaaagctgcaaaaaaaaccatgtttgtttgaaaatacacactcaagtccatacaaagaaaaaaatcaactgtttagattatatgagtaattcaaaaggtgaagcagtttctattgtgtagaccagggtttctcaaccaggtgcgattttgcaccccagggaacacgtggaagtgtctagagacagctttggttgtcattactagtatgtgtggggtgtgctactggcatctaggggtacaggccaaggatgctgttaaacatcctacactgcacaggacagaacccccatgaccaagaattatctggcccaaaacatcaatagtgtgcaggtgcagaaaccctgatgcgaaacgtgatcgaggcgtttcttctgccctgatcatcctttcttgtggtcatctcctctccctgctctgagccttggtagcactgtttcatatcccacactgaataccttgtgatggcactgccactaccactgttcatttttcaggtccataaatcttatcttgtcaactggaacgtgagctgctagagagctctcaggtctctctctctctctctcctggaagaatgtagtgcaaggaggtggcatctgatatctttttgtcaacacggtttataatttctaatttcttgaatacttgaaatgaaatactcaaagccatccaggtaactgcctccttctgagaaaatgtcttccttgagtgtcttttacttcttaagggtttaagaagccatctcctcacccagggccatatgaaaaataaacttccctttgttttaatttccaagaggaagttatcaccaagggacacaaacttgaacttttgaacatggaatggtcaacattccagcttttatactcactgtatggacaatcagtaattgctgctttttaacagtaggaataaatctaatacatgttattaaattctgcatattttgtcacagtttgtgtttgtgtaattttcctttcatgcctgttgcacttgtgttatttgatcatctaatttctcttttacttttctttctcctcctccaaaatggaggcttatttacatcaattattgatctgccatatgtctaatttagccctatgtccagtacttgaactagagaaactgttaaaccaaattagtaataatgtttaggctagaggtggaggggatattgggtaggtactttttgcaaaagtgaatacataattaaataaaaaatagtaatactgttggtggccacattagctgtaaactaacatagagaaaagaaataatgagcaattggttcctttctttgtaagatcccaattgcagtccatacagttattctccatgacttatcacagggtagtccctctgccaatagtggtataagtgaattgaaaacacattacattttaattaatcatttaattaaaggaaaaagagagacatgaaaatgaaacagggaacaaaagctcaggtcacatacagcaatgggtgatctccaaatcttgtctccctgtctttgaaataagaccagacagcatttggccttccggtacatcgtcacctcccctctcagctcggctgcagccactcaaggtttgggacttcaaagtgccatgactcctcataggcattaagcctacagtataagccccagcacccccaacctgcctcactctgtggacttgcacacaaccatgggccactttccatccacatcatcaaagctgtccaaaaatggggcaggggaccctggccttcgtttcaaaaattacagttctgccagatgccacgagatggatgctaaaaccctgttccttcctggattcccctgcctgctcctcacacaaatatggatgtcatgcctctttcatgtcaacacctattgtgctgaactctacacttggaatgtctcaatacctagtgctgtccttataccttgacgaaaactctccctagatttactgagcactctacttgcttaaccactcagaatccaaacacaacatatgtcatctgctttgtccagggaattggacttctaaacacttcccccatggagaagataatccactcttcctttacactgagaggtctcaatgaagaaatggcttccaaaccagccaataatccagccccattttcacatctacctgattcaacaattcattcattcattcattatgtctctcactcattcactttcacttggtctgttttcctccttcatccctcccctccttctcttccaccaccagaattctcaattagcctttcaaatacccacaagaaagtcccactgtaatcctcaccatcactcaaggtcactagcgccaaagcacaacttcctgtcttccatccctataactggcctacacatccagaccctcaaaacccactctccctgctactctccagtgcttctgggatcggatacactattttcatagcccctgtcagggtccattcccacaaagtatgactcacaacaggctccagagctctagtttcccagggttcatgttcaaagtagggattcccgctaccccaaattcttattcagtaagcataaaaaggatttggggatttccattattaaaagtccatttgggtgaatctgatgatcaacagattctagaactcctgtgctcaaaagacagtaagcctctcatcctaactgccttttgtaatgctgatgctattgacagaggcagtgcctaggattaaactcccctttgtgagttggaattctggtttgcaaactccatctacttttcaaaattaagtgaacaaagagaaagatgggaagccaaataattcacactgaatgtttgaatcttaggctgggcagaatttgatagttgtctaggtggtacatgggagtgactggggagaaggacgagtgatggggaaggaggaggaggaggaggattttctactcttcagagcttatggcagaaagttatcagcatgtgagctggagccaggtggtctgagagctaatctggaatgcaccaaggctgcagatacttgatgctgacctgatttcctcatgcaaaatcaggataaagatgatacctatcaaatataagcactgataagattaaatggaataatgcatgctgagctcttaccataaagctggatataaaataataactcaatattagctatgatcatcattatatgcataagatttaggaaaacttaacctctttattttgttatatatcttcagagaattacattgtacacatccagacgacctgagtggaaatcattgttctcatccaaatatcacccaatgctttctttaattctaggtagaataatcaaaaaagacactttgtctccatatgccaaataacagccccaatcagccagtggaacaaccagataattacttatcaactaaggggtattttaatgtgatgcatgataactaaggacttaaaatcacaaatacaatcatgccaatttttaaagggatgtgtaattggggcaagaaaatagagagttgaaccccacagaaggaaagaaatagaatctaaaaatatcagttattttaaaagttcaataaaggctattagtgtataaaatgtataattaatttactatctgtatatccgtttacaggcttatcatatctttgaggttgatctataaatcttcaaatatattaattatatttaaccagctgtggtaaactgcgatttgtcaaaaactggtaaaacactgttttctttttaaagcagctaaatgtaatatatttataatgagcccttcttgcatcagctataagtacatgatgtgacataatttataactataaatatacattttatatgtaaatagaaaagtctctgtattctatttgaaatactgtacttttcacaaatgcattgcttaacaattaatgtggtcaaatcttataatgccaaaatgttttttaattatgtatttcatacctttatgctcaagcttaatttggttacctgttattctctaattacaaaaaggaatcttcatttaagaaagtcttggaccaaatataaaacatcattcagaaagcaggccggtcaaaaagtaaaagcttatggtttctaaatttcaggatttctttatgaaaaaatgtcttctgtagtattttacaatttttaaatttcaggatttgtacaggcagtagtaacaggcaggaaaggagggtaaggggaaggagaaacagcatatttcctacaggtgagacattatgctccaaactgtgatctcaaaaaaaaaaaaaaaaaaagatataaaaacatttccttagggagctttaatggattactgagttactatgggcggaaacttcttgatctctttctgggagacaaccaaaaaggtgcagctaaagctcagagaagaaaatcagcatggctgagcttccattatgagaaaatacatgaaaacagtattggatggtggtcacccaagaaaatgcaataatagctgaatgttggaaagtgacaaattcaacctaaaaaaatacatatatatatacatatacatatgtatatacacatacatatgtatatacacatacatacacacatactttttcctaagttttttttctatcgactcaaatatttcacaaagggggaattacgcctgcaggagcacatagctgtggtgtgaatgactgtgtcctctgagaaattcatatgttgaaatcctaacctctcaaggcctgcaggtggtgattaggtcacgagggtgacaccttctgattgagattagtgccctgataaaaaaggaatcagagaactcagtcagtcgccacttccactatgtgtgtgccctcagcagacactgaaccttcaggtgccttgttcctggactttcaggccttcagaactgtgagcaataaatttctgttttttttgtttacttgtttttgagagagtatctcactccaattgcccaggctggagtgtagtggcatgatcttggctcactacagcctcaacctcccaggctcaaatgatcctcccacctcagtctcccgagtagctgggactacaggtacatgccaccatgtcaagctatttttttttttttgtatttttagtaaagacagggtttttccatgttgcccagactggtcttgaactcctgggctcaagccacctgcctaccttggccacccaaatcactggggttacaggtgtgaatcactgggattacaggtgtgaaccaccatgcctggccaatttctgttgtttacaagttacccagcctagggtatttgggaaaacagcctatataaactaaaacacacacaaatacacatagagttaaagaatatatagctataaagttaggtgaccaaaatgtcctctagtcatcaaaaattatactaatgtcattatgacttgaactgtgtcctccccaaaagatacggtgaagtcctaacccccagtacctaacaaataatctcatttggaaattaggtttttacagaggtaatcaagttaaaatgagatcattagggtgggccataatccatatgtgtcctatgaaaaagggaaatttggatgctgagccagacaagcatagaggaaagaggatgtgaagacatgcaggagaagatggccaaaaggcttgagtggtgatgtgtgtacaagctgagaatgccaaggattgctggcaaccacctgcagctaacgaggtgaggaagaagactcccctagagccttagggaagaatatggccctgccaacacttgattttagatttcaggcctccagaactgtgaggtcatccatttctgttgtgttaagccacctagcttttgtttctctgttatagcaggtctaagaaactaatacacatgcgtagaacagaagtatcacaacccagtcctttttttatcttctaagtttttttaaaagttctctcctaaataaacaaaaatacataagtaatctttaaaacttacataggttaagtttctagtgctgtactgattggttcaattgttaagaatattgactataaggtcagttctgtctttgacatagagttttgaataaggagtttgatggaaaatatctgtagattaaggttctttttcaagactgtgatggtagctgacatttttgcagctttaaatatatactgagtcacatccttagtaaagaaggaaggtaatcgtcaaacattttaaaataccccattgttataagattttgaaataccattatcacagcatttcagtaatgaactctcacagccttcagctctgcccactgttgaagagaagtaatcagtctagatgcatacttcccttatggagcttttaggggcataatatccatccagttagtcatttggacaggcttgataaactaagcccacagtcaacctgccattaaaagcagagtgagttagatttgtggcatcctcagtattaattaaacattgatggtgggcatcactgttcagaagaagggggcatctttacctaatgtgcgcgcaaatctcaacagtcttagagctgaaagggcccttagagatcatctattcatctggtctaatcctgttggaatggggaatctcatattagaactgcgggtaagagagtaggtgaagaaggagcctggcattagaggggagactattaaaataatacctggcaggaattgatgtggatggagagtatagacagaagatgttcagtgtcgagcaaaagaaatagcaagtggagatgggcctggaaggtttgaattcagttggaggaaatcaagcaaacacccaggagaaaggcaagttggggatgatgagttcacacctatctcctgcaggggactttctctgagctgaccttgtatttttaccagcttccaatcttgggtggggtgctgaccagtggagtgggagaggaagacttggcagaaaatcttcactagtgacccaagtcaaccttgccagcgttgggctcagatgtcaactttaagcatcccttgaggcataaacttaggcagaatttgatcatttacaaacacctgtcatttgaacaggttttgggaaggaggccataaatgttaacacctttctctgctctcccaactgaaactctaaaatgccaaagaatattttcaggaaaacatagtgtgcttactccaaatggcacagacaaaagccatacttcacgtctccttccctgatggggccaggcctcagatatccaaatgtagctgagatgtaacagaagagttttaaggcccctcagtggccctgctctaatgagagccagaagttcccaatgctgccacctcaagatattattacagtactgaaatgacatccaaaacacgaacaaaaagaaaactgaaattctgccctcttgtttctcctcacttttttggggggcggggggcaggtcttgctctgttagactggggtgcactggcactatcatggctcactgcagcatcgagctccccagtctccagtgatcctcctgccttggcctcccatgtagctggacctacaggcacaccccaccacacctgactaatttttgtaatttttgtagagacagggtttcgccatgttacccaggctggtctcaaactcctgggttcaagtgatccacccgtcttagcctccaaaagtgttgggactgcaggcgtgagccactgcgcccggccatttctcctcatttctaatgccatgtcctgggtgctgaacaggatagtcccctacaacacagaattatctgacctacatttccatagtgctgagatgaagaaactctgagaaggagaaaaagaggatagtaatttggaacaaatcttacagccataatacaggagtagccttatgtcaccatgggtaggtagaatctcttccaaacaaagaggcataaacccaggaatattttcttctgaagatctcctgaatactacctgaattgggttgaatggtggcctcccaaaacatatatctatttggaacctgtaatggtaaccttatttggagaaaggatcttagcaaatgtaattaagaatcccaagatgacatcatcctggataatcctggtgaatcctaaatccagttgcaagtatccttataaaagaaagttcagggctatattagacacatagacacacaaaggaagccatgtgaagatggaggcagagattggagtttgaaatcaaagaacacctggagccactagaactggaaaaggcgatgaagctttctcccctagagtcttcaaagggagtggagccctgctgatatctcagtttctgacttccaggctccagcactgtaaaaggatagattttagttgtttttaagccaccaaatttgtggtaatttgttattgcatccctagaaagctaatacactactaaacagataatatgttcagacaacttatattctctctaatggccagaactgactggtttaaatgtgacttcagaaaaactttgacaactatattaacaagctaagtgtttctcatgagttacatgagctaaatgacttccttcaccaaaggtaatgtttagtattttaaacagaagaaagtcacacttggtatttgtatcacagacaactttctaaagacagcctcttatctcagagttgataaattttaggcagcgaattcataagcatcaggtgtctcaaaatgtgcaacgtcattgaaatctgtttcgagaagttttaatgtgagcagcagacaggagtaaaatcgtattacgcaagcccttcaggctctctggcaagtgataaaaactcaatgccaactaggttacgccaaaaacaaaagcacagattcaagcataaactcagggagtcaaagtatgctgtaagaattccatggttcttactcctagttacaatggcctctgttgggccttcttcttggaaagactccatatggtgacaagatggctgcaagtagcctgcacttgacgtcactctttgagctcatgattgcaaagaagaaattggtcttgcagctctcaggcacagtgcaatgtcattaaaggccactgattaagggcacttgggtcatttacagcactcaggacccagaggatattattctcttgttgggcttcctgggagacctgcccacctgcaatatatgagaaagaggagccatgcatattagcttcctgtggctgctgtaacaaatggccagcaatttggtggcttaaatcaatatgactttattctctcacagttctggagagaagtcagaaatcagtatcaatgggccaaactcaaggtggtagcagagctatgctcccctaggagggcctaggggagaatccatcgccccttgcagctctgagtggctgccagctttccttagctgtagttgcatcactctaattttcaaagcccatctcttcaaatctctctcaaatccatcttcacatggcttgctcctctgtgtgtgtgtaatcttcttctgcatctctcttctaaaaacacatgtgattgtatctaagaggcacccagataatccagaaaaatcttcccatttcaagatccttaatataatcacatctttgccatgtaaggtcacatttagaagtttcaggaattagatatcttttggagggccatttttcagcctactgcatgatatcactgacaatactgctcaagtcacagggagtagagtcctggcaatcccagaaaaataaataaggcactgacagatgcaccttacaggctaacgcatggatcatctctcagctgtctgctaaatacaatgacgtcattacagaactgagccatcacataagccaaactcaatctcatacttgctttacatttatggtggggctaaacaacagatagtggtagaaacagcacatttcatttcatgctctcattcatgtgttcattatgctcatgaacctggataattcacagctgtttctcagtgcaaatatgcaatgttcatcaaggcatgatctcagagcacaagcacctaagatgctataatatcgatattgaacacatctagacaaagataaacctttagaaattgacatagaaccacctactgtcacatgctagcagagtagggaactctgctgacggtgagaaagaagatacatatccattagttcaatgtgttttccctgactcatcttaggctctaaacagcaggaagaaaaagaggccgcttgacaaatactaattataatgtagatagaaatttcaaagccagattttttaattttgcctgttttctttatgaatcaatctaaatttattagcctttgctagtgctataagtcatgcatatatatgacagacaatttgggaaattatggtaaagtataaaatgaaaaatccaaaccactcaccacatggaaacaaccacttgctaatttacttatttcaaatagtaaatttaacttaaatacacacacacacacacatacacacacatatatatatataatttttttttttttttgagacagagtctcgctctgttgcccaggctagagtgcagtggcgccatctcggcttactgcaatctccgcctcctaggttcatgccattctcctgcctcagcctccccagtagctgggaatacaggcgcccaccaccatgcccggctaattttttgtattttcagtagaggtggggtttcaccgtgttagccaggatggtctcaatctcctaacctcgtgatccacctgcctcggcctcccaaagtgctgggaacttgaatatattttaaaaagaacttgaggatagattcaaagaatgcctgaacttcatatttcttcaccataaatatcaactcctaaaaacttcccaaaagataccattaattttttttaagtttacacacatagatacatgtttctttgtagcatacatttatgtttctaggaggtataatatattataaaatagctggaagagagactttcgaatgttctcaccataaagaaatgataaatgaatgaggtgatgaataagctaaatacccaaatttgatgattatgccaaatatatatgtacagaagcatcaattttatcccatcaatatgtacaaatacaatgtgccaataaatatttttaaaggaatacattaaaaatcacttaatcagaatccaaagaaacaaaagacaatccttgaaaactataagtttaacaaatcctatataaaatattttaaaaataacatattttgaaatttgagcttgcttttagcattaccctcaaagacatacagaagggaaacaatgagcatttctccagcaaaatattcccttttgtaaaagatagatcacttgttgaagaaaaacaaaatagacatggaaaattgattttatcatgaactataataaagcctgagaaattacacacaagtagactgtggtgtttatgttccaccaaaatttgttgttttcatttcttagactcaactactcaaaataaccctatttgttttataattggagcagttttcttggatgcctgttttctcttgtatacctatttatctttgttgtctatataatttccaatagtatttccatttttcttagtgataaaaataatcttcatataattaacactttctctttgttaaacttgtgatttgtgtaaaaaaatctacttttctcataaagtcatttttatagaatcttctaatttgttccttaataattttcgatgaactatgtctatgaaagaacatatccttattttttgtgaattctttatcgatctgatttgtccttttcatgtcagtcttttcatactttatgaatataatatcatctttatattatttttaaagttaaacatacactcaattcataaagaaatctgcaagatctaaaataataaagaaagccctctatgtcatacagcctatatagtttgcttaaagcaaaaactttcaactctttaactggtttatttatgtatttttctccaaatttgtaactaataatattttactgctgtttcttgatattttcagttagaaatattattcactggctcctttttactttatccctcttcctccatcaacatagatgcatgctccctcccccactttctcagtattgatttatgatgattctgtaggaatatgcagtacctacataactatgcaaatactcttcacagatgggccatgaaataagattttactacatcttgtttctcaaaacaattatacgtttcttagagttaataattgtctcttgtttttctatgtagttattatctttttgtcccccacaccgaaatgtaagtctcctttttgtctaaatgcattcaaacacctcagatatcccattattgatatcctcctggaaagatgccttcggtaactgtatcatctactccaacctggactggtggctcccaaggcccgccgcacaacagttccacaattatctccctttgccctcatcccaggaatatttttctccctctcgcctgtattggagcctctatttcctgggcctagtgtgttaaccattcatatatttcccttgatttttcatctcttagtctttattcaactttctgggaaatttttatcaaatttatttactaattttccatggatatttttatttctatgatcatatattttcaaaataatctatgaagccttttgaaatacactgaatatttcttttctccttgtttcatggtagtaatatcttctctaatttcagaagacattcatcataatttcttgtctctctgtcttccaagtttcttatttaatttggttcactctgtgtttttcgtaactgggaactgcaagaacattagagctgggcacccacattgctttgtagaccagccatcattgcttaatctgggtgggatttttttgtattagagtgaccaccgatgtcactatccttaaggttctagttgtaagctgattagataccaacaaaagtgtacgccaaaacccatataaaatatatgcaaagagaaacaccaacaccggggagaagggctaggatctcaatatacagtatatatactgtgtgtgtgtgcgtatatatatatatatatatttacacgcacacacacacacacacacacatatatacacatacatacatatacatatatactgaattctccccttcttttttaagggaagttctcaggggaaatcttggtcccctggtccaatatatcagcagctttgtcatcttccagaattgcactactgtcttcttccagcatggcagaggaacaactgtgttgagacacaaagtgagcgagcaggaagatctgggttctaactgcttcttccattgtctcctgagtttgtggtttctcttgaaaaactggctatggatcttatttttactcctctgaaggttatgtctttttctgttacttgattatttttaagatttatcccttttccacgagttttcagaagtctgactataacgtgctggtgtggttatctattgtatttgaggtttgcagagcttcttagtctgtgagttgatacctttcatcactttggaaaagtttcagtgataattaccaggcacatagcttctgccttgtcctcttccttctccttttgagactcaagttgtatgtgagttagagttttcaaggtgtcatgtgtgtctaatactcttttatctaccctttccaattcctctctgtatttcagtttgaatattttccacagactggtcttccagttcactaatacaatattttttttctgctatgtctaatctgctgttaaaataattcatatagttccatatgtcagatattatttgtttttaaaaaattatagaaaatttatttgattcttttttattctaatgttctggtaaaattctccactctttaattaatctgtctaaattatcctctactttcttccttatattaatcataattatttaaagttaccttctgctaactttactaactgtatcatctgtcactttcatcagccaagagcaactctccagaggaaggggcagctatgaaccagtatcaaacaaccctcacaatagccagggatagggtgccctgttctataaggagagctgggtagggtgtctcttgtgttcatagagattttcctttgatgtacctttattgtcacttaaatgctttattttaaatcaatgaaagaacagtacataggttcccttcatcttgaatcagaaactaatggctatggtttaaaattgcatttgattttgatgctcctttattcaaatggtgcttggcaattcttaggcaatgaattgcatgaggtcttcggactccagatattaccaaaattacatgtatagtcatgcctaatttcgtataaagcagcctattcttagtagggaatttctgcatgggcaacttgcctctgcgatctaagatgcatgtaaataataactgagtattgccaaaaattgaaagtagaattgaatttcaaaaattaaactgagcaaccaacccatataaaatcattgaagggatcatgtagtatcacttgaaaaagtggcaatagcccccacaacagtaagaattgatacaagcagattaaacattgtgttctaatgaagaagtattatataaactcttaaaggttagctatgagagcacagcaaaaggattgtttgtcaaacatatgttaaacaagggtgttgtccattgcagccctatccacaatgactctacccatctctgtgacagttatcaataaattctggatgacaaatggcttacatgttaaagagtcaacaaattaagggttccaatccatccactccagagagtggtcagccaatgtgacttttttttttttcatttatgtttctcctttgctttttattttcactttgttcttaggtaattgggagacagcttacagaacacattatctcttactcaaacaagaaatcattactaaaatttggagcaatgagttttcctggtatgttggcttatttatttttgttagcattttggaagggacatacagataagggaaatgaacacagggcagagaattctgagcatgcccatcactcagcagtcatggcacttatgggggccatttttgacatagaaggagaaatgcattttagataaatgaaatgaactcctccatttatctagcagcttgtgattgtcagacagtgtttgctattggattacataaattgcctgacttcgtttcatgaaactaaatgatatacatgactaacaaatatattcatgcatcttcaatttagtttttgaggccacaagcaaagcaacaatttagaaatggataaagagagttattagaaattaagatatgcacaacacaaaagaatgaattcaataataaagtatgtacttttttgtcaaagacataaaaacacttcatttcagtggcagagactagtgtctgttcggtcagagtcaggaacatcaagaaaactctaagtaagatacctaaaagtattgagtattatcaatcatagtgggtgctatcggcaccccatccagctcttatgaaacaggacactgtatccctggctgctgtcactgttagctgatcctggttcatagcttcccaactctctggagaattgctcctggttaatgagagccacctcaccaggaagttatgtcaccaaacactccaaatgtggcagccgaagaacaagggagagttggttataaatcgccacagcccttgcctcaaatgggattaacagcggttctatatatgctctagagctgcatctgggatcgggttgaggctatactccagctgacaggaaatttttgcctacttcctttctttgctatgtcacacactccctaccttttgagagcatgccttaagtaaatcacatgcttgagaacccctatctcagactgtgtttccagggtaccaaacctaaaacccatatttgaatttcaattaaaaattaacggttatattcactgtaagccagatgtcaactataggtcgtatgctggccagtacaaatgagtacaataaagcagcaattgtcctctggagccctacacacccaggtccaaatcctagctctaccacctatcagatggctgatcttggctaaatcacataaacttgtagacctcaactcctctgctgttgaatattgaaaataatacccccactttagtgctgctggagaactcgatgagatgatgcttgcaaagtgccaagaacagagtaagggcaggatgagtgatgcctgctattatttttgttgctgtcatcatgatttcatgacaaattaggtcattaaagttacatcaaataagcataatgccaagtttcaaattagtagggaatgttttccttaaacaggagttcaggcattacttaagcaagacagaagaaagagtaagtggaaggatgatgcatattaaaaatttaatcctggcagagaattcagggataaatccagtgtactcttcttcctggctgtcctctccaaaatgtactatagagaaaattgaggtaaagagaggttaagtggcttgctcaaagtattcctgcttgttatttacagaaatgttagaatcatgaagaaatctgttggtacgtagcaaaaaaattagaatggtatggcggggtgggatgagggtagaacagggaacagttaagtgtatccccaggggccggtcttgttttccctagcacagactaggagaaaatgctaatatctgtcaatgtctgaatgcatacaaaccacatatcccaacctgccttgtgatttcttgaagttatgtgactgagttatggccagtggaatttgggcacaagggatgcacttcctggcatggcatgatcctttgcatgatcctccactcgaatttgtctttcttccctactgcctctggaggcatggattgaagacgggataccataagagaacactgtgggatcctgaacggcagcatggaaccaagccccacagactgcactggactcacttgcgagggaggaataagtcttctgcatgtgaatgttcagcttctaggagggcgcagttgttttaatggcagttaacttggttcatattctctgaaactagtaaaatcttagtcctcatctacataaaatatacataatcaactataaatcttccagaacgttatttaaaaagtagagtaaatatgtttgaataaatcggtatataaaacagcatctgacagaaaatcttcaccaagggaacagatataagagcctagaatctgaggaggaccgttggtaacgctgtctcaggttaccaacttctgggtcaagatcaactggggatcatgtaattattacacagcgagtccaaataaacacagcaatcaaacattgataaactaaaaaaaaatactgagtcatattgtgttcactcatcaattcaggaaatattcattgagaacttgccgagtactaggtaccataataggtgacaaactttttcttaaaggaagagagagtcacatagtttatattttaggcttggtaggccaggcagtctctgtggctactggtcaagttagctgaacagcagccatagatgttatgttaaaaaaaaatgaacaatatgtctggattccaaataaaacttcattaactattattataggccaacgacatgcaaatgaatggctatgttccaataatacctttactatgatcaacataccttagttgttaactcctgaaagattttaataaaaataatctttaaaatccacttctatgacaataagaacatatgacaaagataggcaaaaaaataaatgagctcagaatcatgatttttgagagctgtgggggagaccagtctctccttgcccaataaatataaaacataatttaaaaaattaatcattgtgaatatctcattggaatagttattctaaattattaattaatatatcatgctttaaattatacagaagaattccaacagagggtagttatattatagtgttatgacccattagagagggtattataaattgcctcaatttatttttaaatttaatttcatattaataaaaggaagtaatttaaacacaagaatcccagcagcttctttagaactggcaactaaagattcatagtttgcatatatacatatatatatatatgaacacacatatgtatatgtgtatatatatacacacaatatatatattgcatatataatatatatatacatgaacacacatatgaatctttagtgtttagatttcttcatatgtggagacatatatattcaacatatatacatagaaatctaaaccgaaaaattccctaagcacatcaaagatcttatatgttcaatcaagtaatcttaatatcacagattagaaaatggcttctttaaaacatgtggaaactgaggcaacaatcaaggaacatagggtttctcaacgttggcactgttagcattcagagtcaggtaaatttcgctcaacgggggggtcctgctctgtgcattgtagaaggtttggtaccacccctggtctctacacgctagatgccagtcaaagcttcccccaccagttgtgacaactaataatgtccccagatattgccaaatattcccagaaggtgaaattgtcggaagttgagaacttctagtctaaaaattgactcacgttgaaactcaatccccccaacccagatatacaggaaagaagttaataatgtggcacatatacaccatggaatactatgcagccataaaaatgatgagtttatgtcctttgtagggacatggatgaaattggaaatcatcattcccagtaaactatcgcaaggacaaaaaaacaaacaccacatgttctcactcataggtgggaattgaacaaggagaacacatggacacaggaaggggaacatcacactccggggactgttgtggggtcgggggaggggggagggataacattaggagatatacctaaagctaaatgatgagttaatgggtacagcacaccaacaaggcacatgtatacatatgtaacaaacctgcacattgtgcccatgtaccctaaaacttaaagtataatgataataaaataaaataaaataaaaagaagaaagaagttaatatccactttaactttggagagaattctctaccgatattgatcatgtagtcagagagatttaagttttcaatttagaaaccatagagaggcaggtggcaaattggaacacagatttcattttttctgcttatcccagcatttgtgagtgagaaacaagcagtgaatttatttccgttagaaacaaaacaatataaaaatggatttggagctatttcccaaaagaattttagtaagacagtgaggttaaatgagctccagcccctttgtgttttttgaactctgttcagtgagcatctacctccagccatctgcggtaggatcccagatgggcaaatgctgtgaattagtctgaggccagctccatttttatatttttcaaaaagctttgttcttataaaataatctccatgattaaggcaagaagaaaacttatactgaagatttgaatctgttattatgacatgaggtaaaagaaacaaattatggccaaccatcactatgcctgaaaatgactggttttcaataggggatggctaaacttcagcatgcagtgagttgcaaaaaaaaaaaaaaaaaaaattatcacagtctctgagcaaacaggtgccttataagtgaaaataagttaacatttgattctctagtcattgatgataaacaggttttattttcttaaattaaaagcaactcttggtctttaaatgttaagagacatcttctcttaatatgttaaggcatacctgtctgaaaatcataagaaatattccaaatatagccattttacttcatagtacatttgtatgtgaatattcatatggtcatgccaagagatttacctcatacagataacattcactcagggtaacagagtacttgtatcccaattcctgctcaaatcttcacggctttagcaattccaccagtgatgtttctagtttgtcaaaaagacaagattttttttggcaaaagggaagagacttccgatttgaagtactgttgactccatgtccaaaatattccttacaccagatttatcaggcaacctgtcttggaagtgagttttctcctttgggagccaccccacaaaagcctatttttctcatcactcaatttcagtatggttctacagagctgagccgccatgtgtgacagtgctttgatagatatcataaggtcacagaatggtgggagaggagtggagagggtgcactaaggtggtgtccccgtgctcctactgtagccaggaagtgtgctggctgctggatggaaaataccaccctggatttcagggcaattgacaagggacaatgcagtggggtctccagaattctatgaatgtcactaagtaggaaaaaagaagaatcattattcaacatccgctttctcatcattgttgctaaaccaatgtcaaagcaggagaaaaaatttgggagagaggaaaattgtaaaacagtattgagaagacaagtggttagtatgtaaggaatgaatatatcagtcaggagttgcctgtctcatccacgaattgtcccctggggtgacagtatgcacatgtgtgttttaggatgtctcttctgaaagcatttcttataactctagcttctgggttaacgttacttttcttttcttgaatttagggacaaaaatatgatgtttacctcccactccattaaagttatgtttaaaaaggttagggaagagtaagcatattaaatactaagggacagaaacttgtaagccatctgttttgactctaccaccttccaggtaacctaatctaataatatcatctaattctgaacatataaaaagaaagaaaacacttcttacaacacagagaatgaatttcaacatgaaacaataagtactagtcagaagtaaaggctatgaggctgtgaaatgcctcagagggtcaccagccaagcaggcacagaatgggttacaaagaggtgttgtctccagtgaaactcaaggatgggcagtctttttcttcaggaagaagataaatagggtgaaggtgattgagacaggacagcaagagcaaatgcttcaagttggaaaatagcctacagtttggaaaacaatatgcagcatgacatgaccagacaaggtagaaactgccctcaggtgatcaggagagtcacaggtaatgcaaactgccacctggaggtgaacctctgtcctgcataggggcaggacccaaggatgccttgtctagtgttaaataaaggttactggtgaactacattcatttctcattgtctccagttttcttgaaattggttgtcctccttgatctgtttcatcatttttctacatttaaacaataatttttaactttggagagagaaaaggagaaaaatattaacctgagatatacaaatcaacccccatgatttgtggtagaaaaccatctttctatgtaataattgaaagcacacaagtcaaacgttctgtcacttattatctaaaactgtgttttccaatggggcgcaccagcgatccagaacacttcaactctagctggtccaaatccaaatgtgatggaaatataaaacacacactggagtttgaagactgagttccagaaaaaaaaaaaaaaagtgcaacagatcattaatttcttacaatgattctatgctgaaattaaaatattttggatatattgaggtagtaaaatatactgttagtagtcatttcccttgcttctttgtacttttttcagtgtgcctagcagatcatcttaaattacctatttggctcacatggtgcttctatcagacggcactgttataagaccctttgtctaccagtgtgcttattcctttctgttatacttgggaactgtcatgtaaattaaaataaaatattcatagaaaccaacaaggcctctttgctggagacacgtgatataaaaaaaaaaagtgtgtcatgaattgccagccttctctctccagactaagtaaacagtaggctacagaactccgtacacagccacataatatgaaaaagcagaattgccctgctttgcaccaatggtacagcagtctgacctctatcattagagccgcatttttaaaaccacagttcaaaaagtcacgtcttcttgcttggtgctatgtcagtagactaagctctcaccacgtggtggtactgatgggcatcctatacttcagtaacagctcatcaatcccatcaataattgcaacctgatttccaccgaaggcagccaagaccaaggaggcaatgatgagaaaagtacaatcagtttccttgacctcacaaaaatatatacacatgagttaatggaaatacatctcctcacttttttgcatctatttatttggacatcatgtcagtaaaatttgcaaaaatatcacaatagactctcataagcccttcacctagattcccctgttaacactgtatcatatttgctttattatatttgcctctgcacatgtgtatagcttctatgtatgtatgtgtataacaattttaaaagctattttgatataagttacagaaatgatatccattatccctatatcttttagcatgcttttccaaaaaacaatgacattctcctatattacagttatcaaaatcaacaaattaatattaatacatttctactatcttatccagacatttgaatttctccagttgtccaaataatgtcctttatagtaagaaaaaatatatctgctgcaagattcaatttgggtcaagtattgcatttgatccccatgtctatttgttgagctttatgatggaagagctctttattatttcttcttttttcatacctttcatgacttcgtgatatctgaagggtagaggccagttttttgtaggatgtccctcagtgtatctgatggttcctcatgataaagttattagttataattttggttataatttttggctgaaatatcaaggacatcttgctgcgtcctctgtgcatcaaatcactgaactctgtcccattgctggtgaagttccccttgacctttgactatttggtcatgggctatttgccagatttctttactatcaagttataagttttcctgttgtaattaataagtatcatataggtaagtactttaagactaccatgaataaatatcctggctgtcatcaaactctgacccataaattagcatctattgatcacttttgcctaaatcgatttttagtataatggttgccaaatcataatctcctaatcaaattattccttcaatattcattagttggcatttgtttactcatttatttatgttttatgttagcatctactcatggattcttatgttattcaatgtgttataatctacctctggcattatctattttgacaatcaaattgccccagatttcttcagcgagcccacttcaagctggctcctagtttcttatgacacaccctcatcattctttaaatattttccttaatttctgaaacaacaagctcttccagtcttatctgagttctccttgcccaattctagattaagtcacttctcaaaaaaatccttcgtttgttttcatggagaattaagtttagaaacaaagtaacatgtatcaagtgtgttcactgctactaagaatacttctaaaccctctcagctgacggagctagcaaatttaaaaagaaatgaatgcgtatatgtaaatatatgtttgtgcacacacagacctacaaaacctcactttttaacacaagtgatatgccagagagtataccatgagaatcaaaatgagtataatatgtagtttctatctactaaacgatatatattttagaaaaggttatctaaaacaatctttaaaatggcattatgattaaattgttgatcattctttttttaattagcaaataaaaattatatatattgatagtgtacaacatgtcactttgatatacgtatacgttgtggaatggctaaatcaagctaattaatatgcaggtatctcacatactttatttatttatttatttattttggtgttgagaacacttgaaatctactctgttagcaattttcaagcacatagtacattgttagtagttatagtcaccatgtcatacaatggatctctttaacttattcctttgtctaactggaatttcttgttctgtggccaacatctccctaacaccttccctgaccttctgggcccctggaaaccaccagtccactctctgctcctaagagtttgtctttttagatttcacacataagtgagatcttgcagttttgtctttctgtgcctggattatttcactgaaggtaatgtcttcaaattgctgatcattctgattccttaataataaattcataattttaccactcaattagctcaatgaaagactccagttatgtactaaattgcagtggaaagacaatttattgtcaattgtgataaaactattataatggagatttattatttattatcatcactttaaaaaatcaagaataatagaaaattcttgataaattgcaatgttttatctcttttgaacgtcttacttatttttcgccatgctagtatggagttggcagtgatttgtgaccatttcacagatgaggaaccaataattcctagaagtcatggaactagatcacaaatcaggttgatgtgtcttcaaagcccttgctttttatcaatattagctttgatcaggggattggctgattttaacaccttgctaagtaaaagatagatttaatattaaaacctagctctgaagttccctaaatgttcacaagcagcagcattaaagagagaataaaataatataaaatcctctccaatcacctcttagagctctagcacatgagagtgagacgaaaattggttgaagaactttttccaaactctacacagcccgaagattctggcatagtctgtagggagttccagaatcttggtgaagaagatatttgtgtcttaactctcttattttctaggagacactttttaaagactagagggaaaagtgggcttttgtgactcagatctgctactaaaataaatacttcatttaagtacaagatctcaggtccattgttcaaaccgcaacaacagaagtaggtaaatttcattttgatctatttccctttattctttgttatagatagcttttaacccaagtattcatatttatgttaatataaattataaagaggaaacaaagctgttttacaagaaattgatgcccggatgcatcaaactaaataatcgatgattgctgtaactgtgggggaaggaatgtgtccaggctttgaagcaatgttccttgaatggtctgtcatctaaggaaggacaaatcaggatcacatccacggaacaaacagggccacctgacaggaggaaaaggctaatcaggaattaagggaggtaatgactcgtaacaagtagggccgccttagtcccgtggcctgacctgctgaggaaacgagcccctgctcaggctggattaacacctttacatgcatctgtcttcatcccctcaaacagtgagttaattgggatggaaaatgaaagcttgagaaaaataaattgcacctacctggataagagacagatcctcaagctgtaacctgaagaggtagtttctgcaaaatacaaaaacagagcagttttatttttaatagatcacagaaagttaagagtttataaaaatttcaagaacaaagaaaataataattttgacttcaaaagcatcttctttctaagaatatgttcagcactactttccttggatcttagagtacaaagaggaattcaagaggtcaacaaatacacattagagattggtgagaaagctaacgaataagtggggtgtgtctgtacatacttacggtaagtgtaagtcattaactggatctcttgatctatatggaataaataaaaggacatgggcattccattctgaaactcttttacttaagatgatgtacaactattcctcataggtcttcctttataattatcacctaaattcaccatgttttataattaagattttgaattcaagcaatgctctgaggttcacagtactctaccttgtaagatggattcagtacgtaataaacgtttagaaatatgaacttgggcccggcatggtggttcacacctgtaatcccagcactttgggaggctgaggcaggaggatattttgatcctgagaggcagaggttgccaggctcctgggaaccatggcaaaatctgtctctacaaaaaatacaaaagttatccaggcatattggcttatgcctatagtcccagctactcaggaggctgaggcaggaggatgctttggtcctgggaggtggaggttgcagtaagctgtgatcacaccactgcagttcagccagggtgacagggcgagaccctgtctcaaaaataaataaataaataataaatacataaatataacttgcattatataggatttggtttaaaaagaaaagaaaagaaacatgaacttggtggtctgcccaaaggaaactgatgacatcaagggcttcaaagagtcaagtttcactgcccaagtataaaataggaaattagagaaaagtaaaatatcaatttcaacaaagaaggggaagaatagtgaaacatgcagtggagatcagtagaggacacagaaaaaagatagattagttacactgggctttggactctagtgttgtaggttttagaaacaactcattaacctacctcagtattctttgcttcagcctctaactgaaatcctggcatcatgtaaatgggaagatggggcggggatgtgcaccagcagcaccccaaagaggaagggaggagaaagccagcctaagtgcaaataataatgtcaagaacatgctggcacataatggtaagcaaactctaagatgcaaatgagcacgaggtgggatctccaagaagccaaggatgctgttataatgggctggtccaaggtcacttcttattggttttacaacacctataagacataaatgttgactattttcactatcgtgggcggggggtgggggtaggtatataaactggacatatatcccagtagaagtgacaagtgacagccaaagaggcccaagggcatagccttgagatgaccaagaaacatccctatgagttatggacagagttagggaggacaaagcccccatggaagccggcactcagaagcacatgtacacacacagctgaaggatgaaagaggactaggctcacattcaggtagtctcatgagtccaggcattgcctcctgggcattcaggtttcacacagtttgcctcctcacatgggggtaccacctctctaaaccgagtgaaaacagcctcacccaaaccacagcaatagtctccttaccacactctttccacctttcaaatctcacctctgatataccccaagagaagctcccagaagcactgcttggcacatgccacctccatcacaaagccatttcaggaaacattcccctgtcctttattataatgctacagccctctatgtagaaccaggttaaggatacctctgaggggagggaatattacaggaaagtcttttgatttagtcagtgccatgagaagactaggactccaacagaaatgtcatctgcaggccaggcacattgccccgtaatcccagcactgtgggaggccaaggtgggccaatcacttgagtcctggagttctagacaggcctaggcaacatagggagaccctatctctacaaaaaaagaaaaaatacaaaaattagtcaggtggcatggtgcatgcttggagtcccagctactcaggaggctgaagtgggaggatccattgagcctgggaggtcaaggctccagtgagccacgatcctgtcactgcactccagcctgggtgacagagagagatcctgtctcaacaacaacaaaaagtccttttcagaggaacaaatgtgaacttggtgcacatacagaagagtatgttgaagcagccaaggtaggtggcactggagggtgactcgcatttcaacattagccaagctttcacccagtgtgaccttgaaaccagcacacctcctctaagggaagcaagaaatctacacacacacacagacaagtctttcagaagcggggcttaccagtgtgatatagtttggctgtgtccccacccaaatctcatcttgaattttaatccccataatccccatgtgtccagggaggggcctagtaggaggtgattggatcatgggggcgggttacttcatgttgttctcatgatactgagtgagtctcatgagatctgatggttttataagcatctggcatttcccctgcttgcatttctctctcctgccaccatgtgagaaggcccaagcttgcttccccttcaccttccaccatgattacaagttttctgagccctcccagccatgtataactgtgaatcaattaaacttatttcctttataaattacccagtctcagctatttctttatagtagtgtgagaacaaactagtacatagcggcaccagggaaattactagccattgtacacccgttgcctctatgagcagctcagctccccaccctcacatatttcccactgtctttctggtttcaggaggctgcccctctgctatgggagtcagcattacctagcaattaagaatattcatgcaaaaaccagagttctgcctctatacaatctcaggaagaaagcatttctttctatgccttagtcttttcatctgtaaaatggagctaataatcaaacccattccctagggttgttgtgaggtttaaatctaagaaaaacacttggaatgaagtctgacccattgtaagcatcaattaatggtgccaacttctatgttaattttgtcattggtcctggaatccagtcaccctactccttttcaacccactggcaattttaagaaggacttcttcagtaaatatttccaataaaagaaactcattcatttagtaaatgaattacctaagagctttggtgatatctcatggttcattctttcttgcttactcacacacatacacgtgcacatgtatgttcacactatggtatctgtctccagaaactttcttgaaaagaagctttcatacacaaaggaagagctggaagtgcatcagggccttgagaaaagacgatagcacagtctgcagtgctctgtagagctctgtgcagatcaagcagagagctctctgtctacttggagaggggagtggaggagacacagagatcgccatccacaacacctgcttccggttttcaggtgttttccatagaagaagataatggcttataataaaaaatacgccactttctcagtccacacctccataagcaaatataactcttctgatcattatttttctgcttctcaagttccaatgggctgtaaaggtacccctcctctccagaaacattgctagtggagtttaaccatctacctcttctccttccaaatacctgagagctatggtgcccttccaatcatctcatcagtaataacaaatcaatatggcagaggtattcaataggggaaaggaaggggcaaagaggagggaggggcatgcttactaggaaaaatagcacagttactatgaaataccatcaccagcaccagcaccatcaccatcaccacatccaataccccaggaaggaaagcaccagaggatttgaacttttctttttgtagtattttctgggttgcaagataaaaattggtgattattttaccccattccatatttttaatctaataatatagagtctaagaaatcaagaactaagagtcactaaagagtatatacccttcaatttatagatgagaaaacttctataaattaacagctgcagtgagatttgtccaatactgtaaggtttcagagaaagtcctgggattagaaacaagccccccgtgtcttggtgtcctttgtcccattatgcctcaaggccccacctattagttattcaatgtcaccttcctaatttcacctgcaccaaacatgcacacacacagaaacaaacacagtaacagctcttatgctactaccatttcataacttcactggtcatttacagcaacatttacaaatcattttaagaaaattcaagtcttagttctgctaataacaaacttttgatcctaggccatcaattttcacctctgggactgtgatctggctgtgatgtatgtctccccttgaggagaacagtttgagcctacgggtctggctgtttaaatggcacctcttttctctctttttattttgcctgaacaactccctgcccatacctaattctaagaatatccctatttcttaacttataaaatgaaagagataaactatacaattatctcaatgtatttaaataatacaaattcccaaaagactgtgaccatgtttagatatacacattgcctaactaagttctacgaataaatggccattcaacaaaagtatttttattatggcaaatttaaatcatttcctgagaagtgtttttcatgtgttatttttcacaactgagtaacttatttcaaaataatcttaaaagaaatctcaacatataaaatagatacaataattctttaatagtataaattgatgtaataagtacttatgtatttgttaataaaatcagttgatgaagctttcttaaaaaaattaaaactccacttatcagaactatttatcatcttacacagatcaacatctatttaatgtgtatattcatgccagttgattggttatatttttgttgattttttatttgtttgatttttaaggcacagagttggtaggtgcttttaaatgtttctttttttccttttttttttttttttttttctgagatggagtcttgcttcttcgcccaggctggagtgcaatggcatgatctcgactcactgcaacctccacttcctgggttcatgcaattctcctgcctcagcctccccagtagccaggattacactgacatgccaccacgcctgactaatttttatatttctggtagagacagggtttcaccatgttagccaggctggtcttgaactcctgacctcaagtgatcctcccaaagtgctgggattacaggtgtgagccaccacgcctggcctaaatattagtttaataaatgactatggtccatggaaaacccaagtagtcaaatacctcactacacaaacagtttagtattcaccttattacaattttcagctattttaaacaatattttattttattttttttttttgagatggagtctcgctcttccgcccaggccagagcgcagtggtgctatcttggctcactgcaagctctgcctcctgggttcacgccattctcctgcctcagcctcccgagtagctgggactacaggcgcccgccaccacacctggctaattttttgtatttttagtagagacggggtttcaccgtgttagccaggatggtctctatctcctgacctcatgatccacccacatcagcctcccaaagtgctgggattacaggcgtgagccaccgtgcctggcctaaacaatattttaaaaggtgaaccataagtaaaacatttgtggaattccctaatcacatcccaagaacctaagaatctgataaaacacagtgtggattctgctattctcaaatctctttccttgaactatttggccccacatacaactccaaatgcatttttgctgtaggaaaaattccaagccagctggcaacatgagggacttgaaatctctcaagacagcttgatccatcacagtttaggtcaatgacctacaaagttaaaggttacaaaaagagagaaaaccttctaaaggggataaaaaattgatattcccaggtgttgggccactcacaaactaaagtaagatctacagaaccctgcaagtggctgtcctccaaggtattacagaagaggcaaccactttatcttgcaattgtgtgagcacagaggagggaaaacaatatgcgtgaggttcatgagaaaggccaccagcctttccaacatgaaggaataatgcttctggcccctggccaactggaaatgctaaccaaatgttgcaagtagggtcagtctccctaacagggcaatgctttgagcaacccaaagcatttaagtgatctcattaatcttcataacacccctagatgtaaataggtagtaataaggaatattgccattcttcagggaaaaaggcagtggtgcaagaggttaagagattagattctttgaatgcattagttgtatagcttggaggaatgattctatacttctatttttctcctgtcattaccaaaatgaaaagcaagagtttgccaaagtgtaacagttcagtgttatggctatagcaaataaaaacatgagttttttctgcctgtggtatggatctacttttttttttttttctcaaatgccatggaataaaatttgacattgcacattcacgtgcaataaaccagattccttttaggagtaataacatatgaggagtacacagatccaatgggctgaataattcaaatcacaaagctattaagtttggcagatgcaaaatcacaatattgaagcccattcttcgtttccccactagacacctgagtgcgttttctacgtcttcaccaaagtttcttgcttactgactctaggattgaataactcattcctgggtcccatcacttcccccagtggcctattagaaacaaatcactaagcataacaatatattctcggagggagcagtggggaccttaatagatgaagttcatttgtatcttcatgtaaagtagtaaaatgcagccggcattaaagaaaaggttgagccatcatgagcatattaactaaatgactcatttcatctagagacactataaaacttaactttgacctccataaattatgaaagacacaggtgttttaaaaggacattctcttagaataactcaattggcctctgatgaatatgactataaaatcaaagaaaaaattacaagttcctattgaacgtatgagttagaggtttgcttacaactgagaaaagaagaattaaggaaggtagatttgtattttgtactagagcaaatgaaggcagaagccgataaaatgtataaagacattttaacaatgttgacagaaacgtttgttgctgattaataaaagtttagaccaaggctgatcacgaaacaatccaaagacaaaacagacactgcccatgagccagttggggaaggctgagagctgaccagtctctcctgtccctgcaccagcttcctgcacacaatactttcctcactgcaagtttccttccatcctcactgctgtcaacatctaactggcacagaacttttcaagtatagtgacatcctacatgatacgcacattttcaattgcactggtagacttttgaagataacaagttatgtttgagatggagtctcgctctgttgcccaggctggatgtgcagtggcagcatctcggctcactgcaacctccatcgcaggcattcagcaattcttgtgcctcagcctccagggtagctgagattacaggtgcgcgccaccatgcccagctaattttttgtgtgtttttagtagagatggggtttcgctgtgttggccaggctggtcttgaactcctgacctcaggtgatccccctgcctgggcctcccaaagtgctgggattacaggcatgagggaggccgaagcagacagatcacctgaggtcagtagttcgagactagcctggccaacatggcgggaacctacccctactaaatatacaaaaaaattagctgggcgtagtggtgcacaactgtaatcctatctacctgggaggctgaggcacgagaatccctgaatgtgcaaggtggaggttgcactgagcagagatcctgccactgcactccagcctgggctacagagcgagtctcaataaataaataaaataaggaaaaatagtaactatatcctttaaaacataaagtgttgtaaaattagtttgattatctaagtgtaaatatttaatatcgtgatcatatcagtaaatttaaatataatgatttaatttaatcatgtaaccaactcatataattcaccaattcaccagcatgtctataattgtgatttccaagacttttcattatgctggtcgactctaagtaaattctaggagactttttattttgtggttataactatcctaaaaaatgtctgcttcatgtatttttttcatgggtttctcagaagataattaaatttcaaaattacaaagcctttccaaatagtatcacattatatttaaatagttagatcacatttaaatcacagtttttaattcttttgtgagtttttttctaaaatattttaaaatatggtgacaaatttataatatggtcatgtgattagctatctcctcagtcagaattttctctaccctcctcaaaaatagtaaatatgtattcttcgggctatgcaaatttcaagataactgtaatttaatttttgttgctgttaatactgttacgtgtgtctggtacccattctcccagaatcatattaacttctttcattccctatcccagaaagagcattttgagctccttaaaagtcttggttattagaaataaatttcaaagaacacactaaaactgagatcaaaccattttaatagcattcttatatatttaaataccaagattaaaaggtgcaaaaatagatggatagtctcttattatttagcaagtagaatgaaataacaaagatacattttaatggcatgcagtaactaaacaatgccgccagcaaatcttagagatataaaatcaggaaaatattttcccacaaatatatttagggtaaaagttattaatcaatattgttaataattacactaatagtttacattttattatgctttaattattacttgcaaatctctaagtgctgtgaggattacagatgatgatttattgctctaaatttaactcgcgacttttgcctttgtgggtcctctgggtatctgatttgttcctttctgtttttcagttaacagagataatttttcatttgaaaaaaaatgccaactgaatatttctatggttcctttaacctgtgatttcctaggactattcatgctttaaattatctccatatacaattaattttctaggttatcttcagtattcatacaaatctgagatcttttttctcatgtatcttctaataatcaaagaattacagctcatcctcccatatgctctatcccagtcacactcccaaaactcactgaatggtttgatgcttcccaccagccaacccactctgttggccatcaattgctgtcaaaatcagaactgaaacgtgtctcaaatctggcttctcatctccattgccatcatcactgcctaagtctaagcaccctctactctcacctgatccacaacccgcaactgccatgcctcgctccaaattctgcaagttctagtgcctagtgcatcctgcacacaatatggtggacgtatcttcctaatgcaaatatgattatgtgaacatataaatgtagaaatctcctgggctcctcaatgcctttagcagaggttctcaaatttaccaagccagcagagcaatgggagcttgattaaatcaaagattctggccgggcacagtggctcatgcctgtaatcctagcactttgagaggccaaggtgggtggatcacttgaggtcaggagttcgagaccagcctggccaacatagtaaaaccctgtctccactaaaaatacaattagccggatatggtggtgggtgcctgcaatctcagctactcgggaggctgaggcaggagaattgcttgaaccaaggaatcagaggttgcagtgagccgagatcataccattgcaccactgcactccagcctgggcaacaagagtgatgctctctctcacaaaaaagattctggcattacttccggaaagtggaattcagaggacttgaggacaggcctggacatctacactcttgaaaggcctgtcaggtgaacctaagactggcccagttggagtcactggtctagaggactaagtctaaacttctttataatctggccccagctaatgctcagagcttcacctataattacttccccctctctgtcaccaacaggtgccacggagccaagcacttttcagcctcatcagaatctctgacttttcccatgtgactctctgtcttccctgccagattcctcaagcatctctcaggccccgttggaggaacaccttctctatgcagcctcttcagatcgatgcaccatcatatccctttactcttggtgttttcaggaccctttactcaggcttcccttggagaatctaattgcttgtgcccgtctcacccactaggccaagatcatcatactttttgttttggggccagagagcagatagtttgcttttgtggtctatgtgccaactactcgtctctgcagttttagctcaaaagcagccacagaagatgtgtgaatgagtgggtgtggctgtgtgccaataaaagcatatttacaaaaacaggaggcaactctggggccccagcttgccaacccttgcgctggactagaaagtcctcatcaggtagagaagatgcttcatctttgtttctctaatgcctaagaagcttcctggcataaagtaggttcaataaatatttgagtaacacagagtcttgaaagaagaactacatgaactaatacatttggatgaaccccatgtggacctggtaggagaaaagctctcaatactcagtctgtagcacatgtacatgcaaataagttattcaattattatcacagccctttgttggtttgctcatgggatctgggaaataggaagcctttgtacatttatttatttatttacggctgtcccttggtatccccagagcattggctccaagaccacctcgagtgccaaaatccatggatgctccagtccctgatatcaaatggattggtatttgcctataacctatgcacatcttcccatatactttaaatcatctctagattacttatatcgagcacattataaatgtaaatagtcgttatgccatattgtttttattggtatcatttttattgttgtattgtttgtttttaatttttccaaatattttaggcttgtggttaaatctgcagatgcagaacccagggaggaccaactgtatgtacttacttgcttataactaaatagataactgttgtactaggctgatattctcccaactcaagcagggaaaaaaaaaatacagatgggaggccgaggtgggcggatcgccaggtcaggagattgagaccatcctggctaacatggtgaaaccccgcctctactaaaaatacaaaaaattagccgggcgtggtagcgggcgcctgtagtcccagctactcgggaggctgaggcagaagaatggcgtgaacccgggaggcggagcttgcagtgagctgagatcacaccactgcactccagcctgggcgacagagcgagactctgtctcaaaaaaaaaaaaaaaagtacagattagttttttttgtttttgtttttgtttttgttttgttttgtttttttacaatagcagaaggaacagaatggttagaaatctttcccaggcatgtcagttggccaccagtttgttaaaagcacacaccctgagccagctaaatcagcagagctgggaggggcatcttaattttgaacaaatgtcctagctaatacttaagaacattaatgtttggcaaatgttggacaaaaggtaacaaagccagcagacaacaaggagactttttaacatatattgggtaaattaatcaaataagcgaattagaagaaaggggagaacaagtagaagaaagagagagataagcccagagaatcataaaggacatacctgtgcataggggccagccctgagaaggaaagggacagagaaggggaaacctttaaaccctaaagtggaggttcataaagatttgattggaagaggacaaaaaagactgcagtgaaaagcactgttccttttccatcaccagctgcttgtcttaagtcataattaatgtaaacacaacatgaaaatcagcattacctgggatctcttcccacaatggggttctactcctttttgcattcactgctaatctctgatttcataccgctcagcatgtattccctttaattgtgtcaacttgactaaaatatactctttggaaaagacgaataagtgtggctactggaagcagaatcgctgatctgataaacatcttcagttttcctgttaattatatattgcctccaaaagagtaattccaaggtaaaattttcaagtaaaaataagaattataatcaccgaaaaataatgatattggccagttgtttaaaataaattttatgtgaatttaaaattaatcccccttgtttagaaccagtgtgataaagtcattttgtaaagaagaaactcattaaatagaagcctaccgtttattttatgcgtctcataagaatatatgctatgttaaaataattgggaggccattagattgaggaggcttcactgtcttgggttcctatgtaaacaaaccaaaattcaactcaatgtaaatagtaaaaggaaacttaagcttaaccaatcagaaacaaaaccctaactaaagtctaacttcagacttaaccaattagaaaccaccaactaacctctaactagggagtttccactttaaccaactagaggcattttctttgtcttgtttctgggaagaatattataaaagtttcctcccttgccacccccacccacaagtggagagctgctggaagtctggtgatgcttgattcctaaatctctaaatgttcaaataaacttgttaaaattttaatgcacctaagtttatcgtttaagggttttgaatacttacagcaaattcagccagagcataaaaacagcaagttaatctttccttttttatctgtagttttgtaaattcaaaccattagccaaacaaatggttcaaaataataaacgaaaaggatcagaaatccatactatttgttgcacatacatttatacagacatatcttctgatatctagaaatactgtaatggtaagtcaaggggtttagtgcaaggtattcaggcagctatgggctgatactcacattgggtcaggtgtgcaaggcgtgcagttatgggctggtactcacatcgggtcagaagtacaaggtgtgtagttatagactggtactcacactgggtcaggtgtgcaaagtgtgcagtatggactggtgcttacatcatgtcagatgtgcaaggcatgcagctctgggctggtactcacattgcgtcaggtgtgtgaggtatgcagctatgggctggtacattgggtcaggtgtgcaaggtgtgcaactatgggctgctactcacattgggtcaggtgtgcaacgtgtgcagttgtgggctggtactcacatggggtcagatgtgcaatgcatgcagctatgggttggtactcacattaggtcaggtatgtgaggcttgcagctttaggctagtactcacattgggtcaggtgtgtgaggcatgcagctataggctggtactcacattgggccaggtgtacaaggcatgcagctatgggctggcactcacattgggtcaggtgtgcaaggcatgcagctatgggctgctactcacattgggtcaggtgtgcaacgtgtgaagttgtgggctgctactcacattgggtcaggtgtgcaatgtgtgcagctatgggctggtactcacattacatcaggtatgtgaggcatgcagctatgggctgctactcacattgggccaggtgtgcaagaagactcatgcatctctagtgccttttgttcccttggtgacttaatgttctcattttgtgatgttattttgtatagaattaaaatcaaacatttccaaggacataaatcattatatctgctatgaattatgatcattacctgatccaagtattgggtctgtgggcctcaatcccaccaccttacccatggcagatgtttaggccatgtggactcacaggtatttgtttgagagcttacagacgaactttcttactaaaataccacagtttgtaagactgtaccctttgatttatgtttatattacactcaagctttttgggaaaagtaagagaatcagaattgagtaattggatgaaaataacttaaagaccaagaaacacatttaaaaacctgaagaaaattcacattttagaaactgagatagatgttaaaaaatgttttcatttagaaaaatcacattttgaagaaaagcacctaaatagccagaaagagtgactccacatcttccccacagttcagtggcaaagactcatgctacagatgctttgataataaactctttttcattagcactgtaggtctttatgcattataaaaatatggccaatttgtaaatgtccaacagcattcaaacactgccttatgtgtcaaccaagttagttggcatttggaataatacttggattcagcacagaatacatatcagagtaattcgggatggaatcacttgccacccttagaatgaacctgaaacactaaagacgaactaattcatttgggaaataaaaatgtaatcaccctcccttgtatctgttgcaacaattcaatctgcagtgaaacttacacttgtatcaagtgtgtggagtgttatcactgccattccttttataatcttctatacaaaaaccagtcataatatattctttcattttgaattttttataccaagaaactgatcttagtaggatttgtgacaaagaagtatgcaatcattcaacaaatattatcccaagagtaggaacaaatagaaatcaaataatgcaaggaaataactgaaatgcttcactgtgattatctctgaaattgtttttttctttatgctttactgtatattctacattttgtaaatgaagatacctaagtttcattactgaaaacacaaatattattaacttttaaagagactgggggaaaacaagatatgactgttgatgcatttaacataatacgaaagttcatgtgcatcctggaaatgaaaatgtatgacttcttccagaaattccctgaattcagatccaagtaccttccgattctccataaccacaaatggctgaaagagaggcttttcttttgcagcctaacgaacttcctttatcaaagagtacaaagaatctttaactgtttcaatttcaggaacatacagtatcactagtataaagtgaaaccatccaataaatggttccacaatgcctagtgctatgagaaaaaaaaatcgactattattctattttttcacaactcatatttttaaaccattactgatttctgaaatatacacctgttatctaaacttactcttgctaaatcaagctttgccaaacaggaatctgagggctgggttatttttaaagttttatatcttactcatatgccctctcaaactttctgagcctaatcccatgaaatttcccaggtgaaattcctattctcttctttaggtagcgtctgcctgaaaggcatatgcacacgtatgcgaaacccatgaagaccctcagagcttccctagggctgcgcgctcaccagcctgcctgttaatgtgacagtaacttctcacgggttattttatttcatcttcgcaacagctgaaaggggtagaaattgttgcatcatctttacaggtgataaaatcaggctctgaaactggcttagagtcacttaggtaggggccagcctctttttttttctgttattatttatcaagtgtctataatgtaccacacactgctctagaataaaaaactacagcccatgctcccggggtcaccaaacctttggaacatacttatgataaacatataaaaggttgttatttggaattcaaatttaactgggcatcatggatttttatttgctaagtctggcaatcctatgtattcatgtccaccatgccatacagcatgctaggttgactcagcggcccatccgatccttcccagcagaccatgttgatatgcaatggatggagacctccaggaatgaggtctgggatgaggactccagggatattgaattgcagattccaggggccctgggatggaagccacaagacacattgggatggagactctagggacgctgggatggacactctagagacattgggatggagacgacagggatgctggggtggaagctccagggaaactagaagacacagagatagagacttccaggaatgctgagatggaaaccattggagatattggacagagacctctagggatactgagagagagagagacaccccactgacactggaatagagaactccagggactctgggatgaagacctcctgggacaggtaccccttgaaaacaattcccagctgccatccacagccagaacaggagcataagacatctcttcaaaataccctaatttgctctgtggcttctcacatcccttaggaaaatcttgagtcactgaccaaaagccaaccacttgcagagaatgaagcgctggtctgttcacacagcacccaggacctccagagacaacaagagaatctcatgagtcaaagtcatagaaaagcctttccaaagttctttagagatgaatgagggatgcaagactcaaaacactaattggggtcacatttgtacctgccccaccccggtaaggggtctgttcccttgactcagagtgaaagctcattttccctcagggtgagctttggtgtatacagcctgccactggctcatgcccttgccagatgtaggtgtctgagataaattgttataatcccaacccccttttccctaagtgttcacctggatgcagaggggaacatagacaaattcaactctggaaataaatgtgttgaatcaacaggtatctttgagcttctataagcaggaaaaatctgtgctatatgctggagaaataaagaaaagacaggcacttcccttgccttctggtaagtcaccatctgataagggtgacttgtcaagaaataatgcaatattgtacattaagtgcagttaaaaaaaaaaagtagatgtccagtatgttactagggccacacaggacagagaatgtggtggttcaggactgctggtggacccttgagccaggtccttactacaagtgggagtttaccaagcagataatttggagtgggggttggtggcagccagtattccagaaaatgagaaagaggtcagaagggaaaaagcccagaggcaagaaagagcatattccataagtgtaggcagaataaataattccacatgcctggaccatgtgagaatgaaaacaggcaagtctggaagggaagtgggaatgcagggcagaagggctggcgtaccacaccagggagacagcttatatccaatgggagctactgaaggtgggcatttttaaaagatgatgttggctgtggtatgcagaaggaggagaacatctggaggccaggagactgatttaacaccactgcaaaacacaggccgaactccaagtgatgaaatttgttggaagtgagcatcagaaatcccccagtattgctactggactaaggtaaggaagagaacaccaagtagccttgtccaatccatactcaccgcctcctcacaaacgtcaaaagaggtgaaggtaacttgctaggtgcaataaactatgccaacttcttcctactcatgtaaaattacaaccattcatcacttcaagtgttgagtggatgtacaaggacacctcaagatccaagagcaaaagcaacgatcctagaaactgttcaatgtttatctagagtgcccagactataagctagatttagctgcactcgtgtttatagagagactgcaaaacctctgtagctatggcaggcatgctttatactctggtacatttggacaaaaaatataatgaactctccactgcccaatgtgccatccttagatgccagaggaacccaattctacaaatggaccctttcttaaactttaatgtcaattttcctaaaagatggatatataatcccaaaataggtaatttaaatgcaaggattatgcaggttttctaaggaagtgatagtgaaaacaggggaaagaactcaaatttgtttggattgtgttccagtggcctcattgtcaaactgggatgcagatgttgacctagatacgggaacactcacacccttaagagataaagataaaaataacttcgttgaatctcaatttactggtatatggcctaatcaaggtaacaaagaaaggtggtggtgggccttggggtacacatcaagatctctggatctctagaatcctactgaagaatatagtgggaagtcaggaacatgttttcaggagtcaaactgactgggtttggaacccaggtccatcttttcttaggcatatgccccggacaacttatttatctacttccttcctcagtttccacatctctaaaacagcaatgttgatagtacctacctcttaggtttgaatggaggaacaaatgagttaattcatgttagaacagttactggcacagggtgagggcccgatcaatgcttactctaacgggcagccatcaacatcttattagcagtagtatattttatgacactcatactgtatttcattcttataagaaataatattattcagcattcttcagttttgtcagtgaaggtcacatgtaactgcacagatgtaaaatgaagtccaaaaatatctgtggtggcaaaatacaatatctctcaccttgctcctacaacaagttctttctgtcctgggtcaaatgttaactgcgagaaatccacagcattcttcgctctgaactcccgtaaccaggggccaatttctaaatagaaaaaataaataaataaaaagataaaaatgaattatttttcctctggggaccacagatagtgcacatcaggtagcagacgttacatttcagagaggattcggaggtccctctatgccatctttcagaggccactggaggtttccctcaggatgccccataagccatactaagaacttgtaaagcacagagggcagccacccaataaagagcaagcgaggcatcaatgcttggttgtgatttacaagccagatgtgcattttccttttggctttgggctgggcagaaaataacacagcattcacatgattcatcagaggaatactgaatgcaaacaagaccatttcctgtgcaacttgactcaaaagagctgcagatttttaaatattacaaaagcctccttaggagcaaggaccaagcacacaagcatcatttgccttctttcaaattagatgttccatttccctgtcctttgggtttctattttggccccatgattagacttgttaaacacattccgacctttctagatgagaaatccacagttacttctaggcttcatttgcatttttttttctaagggaaatcagaaaatagccactctatagagacaggcttttacaagcacggttaactcctattagacagcctccagcccagagtccgataattataaaatgacagtatttgaggagagataggatgctgcttcaatgagccatttttgcaactttcattagctcatttttaacactaaaaaatattcagtgagttgcccaccaaacgtgggataccttatcattatcattgacaattaaccataacatctgattgtcgttttttcttggatttagtattttgaataacaccaccctgactaaccaggcacataacaactgtcaaatcaatgaagatgttggtttgaggaaaaagtgtgtgatacaggaaagaatctcctccaacaaacgctgatgctaaacacatcagtgttatgtttttaatgggggcatatggaaatatgcccccattccgtctcatatcctaaagaaatcgctttgttgatgtgaatgagagggactattttttcaggaatggttctgtataataaacatgtcttttctctactaacagttacgagggggaagtgatatcaagtaaaatttatcttctgcttaaaggaaaccaggggtgagtcatatagagagggacttgtaatgtatatgatagcttgatttttttaaggattttcatataaatttctacattttataggcaaatcaattaaaatacgtagaacaaggtatgtacaaggcaatggaactatgaaaagttattaataatccttccaggactttataattcagttaaagaaacagcactagtatctttaaacagggtgtctatcaatgcaagtgtttataggggcttgtggggttacaggaattattcttatatgaaaagaagagatgattgagagctgcagtaaaacaagaggaaagatttgaccagagagtgacaggaaagatgtcctagaggggcaaagcaagacagcaacatgggaggccatggtgccccctgtggccataactggtatcactcatcttcactccatcaatgcctccattcctgggcaaaagagaacccaatggctcttgcgtctgcattgctccctgcagtgcatgcagcatacaaaacagcacattgaatgcgataggaaataataaatatgtgaaatgaagtaagaacaagtaagtgagttcaagagagaaataatcaaaaagaaaggaaataagaaaaagagaaaggagaaaagaaaaagtaatagcaacttaagaaactactaggaaaggaaactgaaaggtgtatttaaatacaaactgtagaaaaattcactttcaggttaaaaggtttggacttgatttcatatgtgacagcaaagctttgaaacgttttcaggaaaactcttgacccatttgagcagatgtctttggaatatcaatgagcccttgatagaaagaatggtctggaaagagtagagaatggaaggaaaagtagtatatttttaaaaacctaaaaacctacaatttaggtattggccttgaaaatgaataaagaagatgtgggatcactgattagagatgaagtcaaggtaaacaacttaaaaagaacaaaacagttaccaaattaaatgaagaagaaaacagtgatgactgagacaggcatcagagtttgaggtggctttagagaaagatagtaaattcaggtgcaagaatgggaatgtttcaggtgaaaaatttccaatggtaggttggcccacagccattgttaaacatcgctaagacctagaaatgtccataaagatgttctagttcaggaggttcatcattcagatgggaaacacatgaccagggagcactgccaggaccaggctccagagtgaatatcaggggctctgttcaccacaactcacagcccccagagctgggctcacatccaatcttcaaaccacatgagggaagaacagagggccaagggctgaccttcctgctaggggagtgaagagatgagcctctaagaggaaaaaagactacgaaagatagaagaaaatcaggttactcttttcccatgcattcatctttctttttatttagaagacttggaagaaagtggccaacaggaaccaggctaaagagacatacatcaggttttggtccctatactgaacaacgggaaggcagttttgctacttcctaaaataccctgaagtaataaaaggagtcatgtacagaggaaaaaatgagttaacagcatgtagttctgtcaatattgttcaagtttccttatttgaaattctaatgaactttcccaataaaactgtgtatttttatggttaacatagatcaaagttgagtaatctgcatattcccttctctttcctccagaaggttggccatctcaactttgcatattacattggcttctatctcactgataccaagagagccttgcaagaaagtctctgcaccaactcacctcttgaactaaaaagaagcctgcaccaatacctatcctcccaactttcccaacagatcagagaaaaggcactcaatcctcttttcaaagaccagttgctctcatctcttctttcccctttaatcgcttctcaattacctaggctttcctctaaaatctccaatgttacctagtccctttccctctgcctatatgtacatcctctcctatttcaaaaagcattacatatttttattacactcccttgttattatagcttcaaaaaccccaataaaatgcataataaacttccaagtacaatatagcaatatatcaaaaaaaaaatcacacacatacaaacacacacacacacatacacacacacacacacacacatacactatatttcatagggaatagggcttagcccagaaacgcaaggatggctcagcaagcttagtaacagaaaacctattactataattcatcatcacaataacagatttcagtagtagcaggaaaacgtcatcaatactgctttctaaggaatcagaaaatgaacagttttggaaatagaagatctaaaagagttcagggcaattggtcacaaactagatgccagaggaagttcggggagagtgagggagcaggagggggtccacagcaagtggtgaattgaggggatacaattttcaataacattaagatgctcattgcccccagtgagtttacctttttcctcctatccctattttctgatattgctgaaataaccatatgatgaaatggagcttaaatatggcagccaatatgactatatatatataatatatataatatatattatatatatataaaattggaagttaagttataacataaaatttgtaaattccaactgaacacttgatagataattcataatatttgaggttaactatcctagataatccaatttttacacatatatttacgtgattgttgaaatatggtctccagcaatgattttttattgcaaaattacattcattgattcttagttgccttctcttacagctacataagctcgcatgtgattggtgtataaaatattttatcaaaagtataattccattttttttaataatccagtcttacaacttcaagaaacgatttattttatgaacaagtcagtattaataatttggtccaaaatacttgacaaatataactagagataagctaaatagattcaagttaatgtcccttccaaaaaagaaagaaaaaaaaatcaaagaaaaaagaaatgcaaagaaaaagaaagggaaagaggggtaaaagctactcttttaaaaaaagcagacactctaaatatagccaaggtaatgatgtttgtaaaccaaaacaacaacagcaacaaacaaacaataaagggcagctcttgtggaagacatgacagtcattccaaaatctgactgagagccactccacatgctaacacctgcagcgccaactgtccagaaaccaatctgatttgttagcaaacactgaccagggaaacctcccaggcacactaagggctggctccggatacctgtttcattcctcacaccttcaaacttcagttaattaaggggctgagaaagcaggatttcaaaagctatatgggtgacttgaaacccacattggaaactaagattcaagccaaactaggtggggccaggggacggtgggtaaagattgttgaaaagcacggagagcaacttacataacacacataagtacagtatgtagaaatacaagtgcatatcacagcctacttctatttatcatgtagttatgtaaccgatttagtctgcatcatgacaaaataacgctaacaatatgattatcagcaagacagctcaaaaatagctaatgtttaaatagtaggttctatcttatccactttataactattaattcctgtatttctcacacctgccttatcataggtgaagaaactgaggcattgtaagagtgagtgttgccaagatcaatagctggtaagatacaaacccaaccagcatagtttttgtggttctagccactatgctatattattaaacttcagcaaatataaaatttagcttcctatacagcacatttggaaaattacaggaagaaagaaaaatcgacagcctctccactttgaaagttactctattcccattgatagactgttaagcaaaatcactacgcactcagttttcaactatggactagagaaaaatgaaatacaacagaaagctgggtctctcaaaaccagctactactttaacctgtgaataaaatattgattgtttttgcccatgttaataagggtgatgatctacacaaaaaccattcatcattttttattacccaagtgtctttatgtaagtatggaggaagaaaatgacaaccatgtactgatctgctttattggagtaaagaacattctgaaatcagaacgtaggaatgatacaagcactgtggaatgcttgagtttctaagcagtctaaaccactcaactccaatacaggagttggggggcagggacaaggtactgtcctgaaaatgaaagagctgtgtcttcacctcctcaagatgggaaccttctgtgagcagcacaggaaaagaagtacagggcatattctctgtggagaaattctggaagttcttttttctgacctcttcctgaagttgtgaaaagatccatcctacctcaaaggtagggacctattactccttaaagttggcatgcttctcccttctatggacttcatttttggtttcagtgcattacataaaccatcctatcaatgaaatctgagccaaaactatgatagaaaaacaagggagtggaatgtttaaaagctaacacaagtagaagaagagcacggcaggtctgtgctggtttactatgctgtgtcttgcctgctaccagtttccttccctttcctttgcagtttgcgttaccaggcctgttacttcaacaaccactcagaacaaggtaatctcactttggacaataaatcagcagcaaccccatgccacgtgtacccccaaaataagatacatcaggctttcaaccaacttggttccctcaaatcttttcagtgattatcatagctttcagtcccaaagcttcacacacttgtctggtgccagcgtgtgaatgcaaaacacgtcataagggaataaacatgcacattcatagatgtttaaaatatgctgctgaaaaacatacatatcagaataaccaacatttcttacttatacttctttatttactaactatattttcagtactgacttggtatcaggaattgtatgagatacttttacatattaactatttttatgtttataatcttgtgaagcgagagctatcatttttgttataaaatttttttaaaccctgaaattttgacaagttaaatatccaaacatgacataaggaataagtagctaaactggaatttacatccagaataaggctaaggcaatatttctataagacacagattaaaaatcaattttccaaggaatgcataaagagcatgaatccttactgcctagtaacatatacgcatggattaatttatcaaaaatggtagttgtacccagcaaaggagagaaaaattggaaagaagggaagctggtaatttccagataggagacaggaatgttccagcttggctgcccactgagcaggacataagtgaaggaggagtaccccagagaaaaacagaaagaaaccagggcacaccccaggcagcaagaagtccaggggaaagaagatctcaatattggagaatttatctccctcaaatgactttccaagacaagtcctatttacattagcaaactccaaaatgtacagatatgctaaaccttacttttgctttgtagaaaggttggaaaatatgaggccaattttttatctccaaatatatgagcctctactattttcagtataactcctattgagggcttagttgaatcaaagcaggttacagcagggcatgacattagctgcacttcagtccagcccttgactttatagttgagggcaggtgtgttacaccacctgcccaaggctatgcatgtgcagtgagctggaaaatcccaggtcctaaggttcctttgctggtctattttcttccccatcacagcactagtagaatatctaagtagaagtaccatggctgaacctcacctaacaccggcatttagatcctgagatttgacaagtatttatggtatggcctgaaaatcatgcaaacaattgaaaacatgaggtaaacccacccctgtttcagaaaggtagtggatttcaattggttacaagatgatcattgtttccaatggaattctgcttcctaacattcctcttaaaatatccaggaaaaatatcaaacatgtttctttagttgttctatattatccttcaacaatctaacttggagaaatgatgggcctggaaagtcacatgggagtcccttccagacatgaagcctgtccaccacctgccctggcagccttggtcaccagctgcctccccatgcaggcccctgctcctgccttcactggaatgcatgcattctttcctacaatttcacagattggtggttagtatttaatgctgatttacattatggatatatatttataacatggattccaggatgtaaaaaaaaaaaaaaaagtggtctgtaccaggctgaccacattatctgagcacatgaaaatttctaaatgatagtattttaaatgaccaaaattatatgtatctatagttatcaatatatctcagtcccaaggccatcccactcagcaagcatcctccttcaaactacccagtataagaacaagaaagctcttgcagactgcacttagtgaagtagattaagctttccaaatgtggattatagtcatattgtatctagatatattgtatataagtatatacacaatacatatactgtattatacacaacacaatacatattttgtgtatatgtatgcagtgtatatgtatacacatgtatttatttctatatatctgtatacatatagacacacatatacatgatagggagagaaggcagagagattctaggtggacatgggagggtccctggagaagaatcaccctcaagcttaaaagcctgacagactgcagcccaaagtgacaacttatattctgttttcctgcttgaatgttaccttttcctaaaccacccatgttcccaccccaccccatcctgtgcctataaagaccccagactcagctggcagagaggagaagctgctggacattgtggactatggctggatgttggagagaagttggcttgacttcagagggacagtttgatggtgtaactttgaagaagaatctggccagagatgtccggactccaggggaagataaccttcctgccccatcccctttccagctccccttccactgagacccactttcattggcatttatcaccatttacctccacatttaccacccttcagttcgctcatgtaacctcatttttcctggacaccagacaagagcttggaaaccatgggggcagacacaaaagggcctgctgagctgttaacatttaagctatctgcaggcagcagagctaaaagagcactgtaatatgccctctggggtttcaggggtcacaggttccccactagatgttggtgcggggcctacagggagttggctcctgccagcatccaaaattgctcaccctggctcctgcatctgctcacctgtatgctccctccagcatggggtggaacacggagggtctgagtcagtggaactcacccctgctagtgccaaagtggccagctggttccagcgtgtgtgcactccatttccggcctcgtttgcacactccctcccacaggagttgagagctgagggctgagtaaatgaggcatccctatcacaagtcctgggaaggggtcagggaaatatctggcttcatacacacatagatatataaatataggcatcaatgtggtcattgtgtatatatatatgtgtgtgtgtgtgtgtgtgtgtatatatatatatatgtatttgcctaagtgtattcaaatagatattatagacacttaatagactacagtagaaagaaaaaaattatctcaaaaaatgtctacaggaaatgagtctgtcccatttatagaacttttaaaaaacaaaaatatttaataataaccaattagagaaattaaaacatttcgtatcacgaaaaaagacccaaaatagcaggaagcataaagcatctttcatttgcattttcctttgtaaatatgacactgaaaacacagcattttaaaaatgcaagcagtgctttttcgaatcttttctggtttctattgcagtctgttgaaagtgagtcaagtgttctatcaagtcttcatatgattttgttgcattaacacatagtatacctaacccatttctcacatgttcattgtagaaaaatattcacaaactacaacttttgcaaaaggtctacactctggatttggattcttgtgaagttcactgtttcatcttgggcaggcttcctggtggatgtctcagaaaccaaaaagctgtgatagctcctttttactcgatgagttcctgattgggtcttccttcaaacaccatttgaaaactacaagcttgtgtcacacatttttttcttttcttttttttttacatcctggaatctatggcataaaatgtatccataatgtaaatcagcattaaatactaaccaccaacctgtgattgtaggaaaaaatgcgtgcactgtttcagtgagggcaggagcagggacctgcatggagaggcagctggtgatcaaggctgctggggcaggcggcagacaggcttcatgtccagaagggactcctgtgtgactttccagacctaccgtttctctaagctagatcgtcgtcacaagataatactgaacaactaaacatatttttccttggtattttgagagaaatcttaggaagcaaaatttcactggaaccaattaccatcttgtaaccaattgaaatgcactacctttctgaaacaggggtgggattaataaattccactgttaccccacgttttcaattctttgcatgattttcaggccataccacaaataacttgtcaaatctcaggatctaaatgccagtgttaggtgagggtctggctactccagcccaaggagttccgagtcattcaagggttgcctcagacccacctggcaagtgcaaagagacactagtgaaaagttgtctgtaatctgagttcaaaatctgcctcacaggctagagttgccttcccttttgtttataactttcaagatcttggtaaattcctatttcattaaaccatctgaagcaattaattaggataagaaacaagctgataagtgcctgggttttattgctagataactcctagaagaagcaatttctactcatccatcaggaaagacagattttttttaaatttataagattatgcaaattcatatattataacacaaactaagcatgaccctcaaattcctggactgtgattaactttgtccttcaggctatgaagttggtgcccagcctgcccctcccttcaactttacgtggcttcaaagtactttgagtcacccataggaaactttgcccagtgcagaagggttttcattttgactcctgacctgcagcatatgattttaggctataaaatctaattgcaaaatctccatgttgtgacaaagaacaacaaaaagtaatttcccttagatttataactttagaattacaaatgatgttaatatgactaaaattacaaaaatgaacaatttctattcaataggcacttagattattccagaagtggccaaagtgctggctgtgtaaacagtgatagccagaagactgacagcaaagaaagccattcgccaccagataacgacagagattgcagaggaacgtgccagagatttcttagagccttagggtgtgtggttttaaaatatccagaatagttctgctacatattcagaatttgccagacctcagctttaagacaataaatcatttgcttaaggaaaatctctttctgtcacattctcacaattcacacgtaagtttcctgtctgcctcctcactataggaaaatctttagcttctaatctaagccactacttcttcagaccttaggattcaagggaagaagaaagctgtggaactcaggagacaagacagggtcatgcaaggaaggcttcttgcttgaagagaggtctaataagtcccaaggtggcctctttgccgaagtacagattctatctacacatcggaactagaacatatttgccaagtcagaccaaggtttttccaggaactttagggttaagcattaggtggatgtgcaccaaaaatactggggcagcacaataattcatgtacgtagtcaagtaatatttatttattgagtacctgctacatagaagaaccaactgtaggtactgcctggaatacaaagttatataagacagacctctgccttcaagacatttataatttagctaagaagatgagatacacacaaaagagagttaaactgaagaagataaatactatctgatcccagggaaaagcataaagatgataaatgctctaaagcagcaccatccaatgaaaatgtaatgtaagctgcacatgtaattttgtatgtcccagtagccatgttaaaatgctgttaaagagggttgggcacggtggctcacgtctgtaatcccagcattttgggaggctgaggagggtggttcacttgaggtcaggagatcaagaccatcctggctaacacagtgaatccctgtccccactaaaaatacaaaaaaattagtcaggcatggtggcatgcacctgtaatcccagctactcgggaagctgaggcaggagaattgcttgaacccaggaggcagaggttgcagtgtgccgagattgcgccactgcactccagcccgggcaactgagcaagattccatctcaaaaaaacaaaacaaacaaacaaacaaaaaaaaaacatgctatcaaaataaaattcattgaggtatctttgtgtatgtgtattctaagtcttcgaaatccttacacttactgcactggacacctttcaagtactttgaagccatacctggagagtggctacacgattggacagcacatacccaagatattaagaacaggcttccttggtaacatggagcctttgttggatggaaaaacaaattaacttgtcttcttagaaccagctgccatagaggtcagcgcaacctaatcaggcactgattccaacaaaactaccctgcatttaccaaatatactgatgaaagtaacacagtccttggaatttggttgatttaggttggaatctcacaggcagaacttttttctcgggaaccgtattcataagtgagtagtttaataatgggttgactcagcaggtctgcggtattcaagccaagcatgttccaagagagtgtctggtctttgactggctgctgggaaataatatctaagcccttacaatattctgcctgataggagtgtctctctctcttgacctgagatctttgatccatgccagatagtctacactaacaatgcagtttacagtggggacctgtggccaggctgcatctggttgacttcaggaagggctggagtctgagtaactaaggtcagccatgcaagcattccatgcttttgtgatcaaccctcaataaatccctggacaccaaggctacattgcatttctttggttggcaatattccattcattttgccaaatgtcatttctgggagaatacagtgctgtccttatgactgcaccgggagagaacaatctttcccaagcttttctgagctcaggatttatacacagtctttcctaagctttgccccacatgccttttatgggtgctaactttaatctacatctaccccatcactgtaatcaaccctaactgcaagtataaatgcttttctgagttctgtgagtccttctagaaaatcattgaacctgacagtggtactggagaccaccaactcaaagcttctccctcttgtgatgataagcacagtaaacacaataataaaacctgtataaatatccctggacacagatgtgttagtttggaagagtcagaaatatatagaaatcactgtctcactttatcagggcattatggtacctgcttatctaggaagagatccagttccctccaatagcatcagaatctcttaggcagcaatctttagcttttacaaagggtaaattccttcctaggatcaagcttgaaacttctttacatgagttataataggcatgtggctagaaactagacaaatgccactcatgatccagttccctccaatagcatcaaatctcttaggcagccagcctgtaccttttccaaagggtaaattccttcctagaatcaagctttctatgagttgtaatagatatgtggctagaaactagacaaatgccacttatgatataattagtgcatttcattgttatctttcttcacatattttatagcccccaccgtttttttttcaaaattaacataagaagtttattgccttatgtattcttactttgtactgtctcacagaaaccagtacattaccaacaaattaagaaaaaataatagacattccattccatttttcattattttattgagcaattaacactgttattcaatgaagaaagccaaaatgcaatctggtttgcataaatatttcaacagagtgggacagaagaaaagtcagatcccacatcatgagtgtccccagttcattgtgaaatacacccacacagatgaagacatattcttcgtctatggtgtccccatggacttccagacatatggactagctaaaaacttttggaagccaatcaaatctcaagtctcaaagctgtactctacttgcattggctttctctgtctgcaagggtctagagaccaaggcactctacctttagccttcactctttctcagactccgctgcttttcacttctctctcatcgttcattcaaggagacccccttagccttgctataacactgattctcatttctccatgttgatatcaggattccatcctgtctgaattatcttcctatgtactccctgtttactcaaattctaatgaatgtaacaggtcgggggggttacttaagagtagggtataagtttactaatatctgtgttctcttatctagtgaaatagtcttcaatgcatgtgttaaaaggaacatgggtcatatcaaagcagcatgcagtcctacatgtcatctgtattcttccttaataacctcactaacctccctcctttccaggccaccagacactaccaatctgatatatctttttattttattttattttttaatttgtatctatctatccatctatctagctatctagctatctagctagctagctatcgtctatctatctagagatcagtttatggcgctggctaatttttgtatttttcgtaaaaacaggattttgctatgttgcccaggctgatcttgaattcccaggctcaagagatccactggcctctgcctcccaaagtgctggaattacaggcatgagccaccatacctggcccaatttgatataccttgactagtgattgtgttcgagaagcacttatgaactatattctatcattcttctaatcattttacatgggattgtttatatccaaataatattgtgaatttagtgaaagaggtcatctttaacatttatgaaatataagtattagtctctaggctctaaaagagggattggcaaactatggcctatgggcccaatctatcccatcacctgtttttgttaataaagttttatcagaacacagccatgcccattgtttacatatgttctatggctggatttgtgctacactggcagagttgagttcagactatttgacctgcaagggccaaaatatttactatcttaccttttacagaataaaactataccaacccctgctctagaaaatcatagagtaaaaggctcaacaaatatgtattacagataattaaacatgctaagcatagtgttttagaaatgaaagaaagaacaaaagaagaaggaaggaaaggaaaggaaggaaaggaaaggaaaggaaaggaaaggaaaggaaggaaggaaaggaaaggaaaggaaaggaaaggaaaggaaaggaaaggaaaggaaaggaaaggaaaggagggaaaggaagggaaaggaagggaagggaaaggaaaggaaaggaaaggaaaggaaaggaaaggaaaggaaaggaaggaaagggaagggaagggaagggaagcaaaggaaaggaaaggaaaggagggaaaggaagggaagggaagggaagggaaaggaaggaaaggaaaggaaatgaaaggaaaggaaagggaaggaaaggaaaggaaaggaaaggaaaggaaaggaaaggaagggaaagaaaggaaggaaaggaaggaaagaaagacaattttaaagtaagaaggaaccacctctgggcatatctactcatacctcttccctaagactccagaagagtagagggtcttgctgaaattcacccagctagatatcaatgtggattagcttagaaagagcccctaatcgttcaccagatatcatatatctggtttatcatatatcacatggcatcaataaggaggagcacttccacaatattgcatcccatagttttatatggcatttaatatcttccggtgaaaatgataaggacatgcaggaaatcattaccctcttcacaagttgagtattttctacactttcacacaaaatcgttttgaaactccagctaattactatacttccatttcctctgagggaaaaaataaaataaaaagcaaaccttctggaattcctagcacagcctattagttaatattatctacagtcccataaagtcactggcctcacccccaggcttgctttggtatcagcagccccaagtcaaacaccaaagatgttaaactttaaaaaaagaaaaagcacgtgttaaaaaaaaaaaaaaagaaacaaaagctgacatttatggtttcagggtttttatttccaacagaggtggatttctgccacggcccagcaacccccagagagctcagcatgccacacctccaaatcaccagcctctgcaaagacaggttcataaggcaatgaggaaaataaatgtccttccattggctttgccctttttggtgtattttggccaatctcttcatgctttcatttcaaggtactaacctgccaagacccataagccagggggtataatagtcactcttgtttcccagcgtgggacgaagccatcacatggacaaactagaaagctgtatttacagccccactgacttcctgggagagagttgtgaattcaatgtcacagtctcatttctaatcttgtttccaatttttcttgacatgtttatattctcatttcctgatgtgtgccaaacagcttcagagacccttcctgctctgggcccagttttcatggtgtttgtcatggtgaactttaattatttgcttgaccccattaatgtttcttcactagaccgtctgctcccaggcacgtgacagctgtttgttcattcaagccttcgggcagcaaacgtgtacctactctgtgcctggtcctgctgtagacactacagacgctgcaggaaaacaagtagagaaggctgttcctctcattgaatgcttatccgaatgagggaggcagaatcaatgaaataaggagtgccatgatgtaactaaaacagagtaactttgtagagtgtgacttagagcaacatggtagagtctgtgaggaaggccagtctgtgcaggtaacatttaagctgagactggaatgacaagaaaaagccacatagaggtctaggcaaagggcattccaagagagggagttgtctggggaaaggccctaagctgatgatgatccagggcaaattaagcaagagaagcaggacaggagtgtaacgagagacaggagaggagaggtgtgagggaggtagggccactgcatgcattatcttgcaagtagaggtaaaaagctttggattttattctatgggagaggttggcaaacttgttgcaaaggtctggatagtattttaggctttgtgggaatatagtctctgtcataactactcaactctgcctttgccaccacagacaagagtgggtgtggctgggttccactaagacaatattcacaacgacaagtgggaggctgattcagcttgcagctatagttttgccaacccttgtctatggcactaggaagccaaggtatgtatatggaacagtcaagggggaggcatgagctgcgtggcattttttaaaaactcttaggactgtagcatggggaatggtctgcagaggatggagaatgcaggaaatgggatagaccacagtggtctagagaagatggaggaaaggaggcagatatgggaagcattttgaactaattgattagggaaataaggaaacgtgagaaactgaggataacacccgagattttcactagaacagctcaatctatggggtgatttctgagacaggagagatggagaaaaagtaaatttggggaacaatccaatagttctttcctggatgtctacgcggaggtcttcactagaaattgcaatggagaggtgagtaaggtgggaacagagaagtcctggagctcagaggggctgggcagaagataaaggtttggtagccctcaacataaagatgtcatttaatacggtgctagaggtgacatcgaggtgaggaacgacagaaggagaagaaaatggccactcattactgagagttggaagaaagatgtgtggagtgttctgcattagaacaaatgaatgcatgcagaaatgaatgaataaagcccacatccctgcattaggagggtcatcttattcctctctatctacaacctctatagttcactgtagaatttcagagcgatggctatgacgattttgatcttagaatcaatttgattatttaacgccatccctgatacataacccatttatcttcatacaggcttttaaggacttcccaattggattctgtttctactgacatccatataaattggaacctgctccttcccttcaattctttccccagaagtgagagctgatagccccaggtaagtccccagcccccactgaagacgcatttcttctctgagggttaccttgagagacagaggctctgttggttatgattagatggtttactaacataattgtgaacataatttgttctgatctgcttctgccttccagtcaacccacgttccgtatattagaagaagaaagggttggtgtgtgtgcatgtgcgtgcacacacacaagtgaagagtgtttagttctgcctgtctgtgcctcagggaatggaatgtaacagatgttacagtaacacacattttttgctttaagaaaaggatgaaggaggtggagtgggccaacttgtagacactttggattccaaatcaaaccagaaaaaaaagaaaaggctgcacacagttagaagaaagtgcaagcggaaaagaacccccaccaagttcaaagggacttgtgtttaatcagacaaaaacaatttttatagcctcgggagcccgtgtggtgtgtgaggaagttgtgcagcaggatggcattaggcactcaagccagcatgcttttgtgttattttcttctttctttgtttgcaaccggggttcaaagaaattcactgtgcaaaacagatactgaagtagatcatacccacgaattaacattgtcatgacaagcagctctgtgttatgagcaaaattacaagtgacccatcaaataaagcagttattgtctaagtaagagctcctttcttccaggattccaccgtgttgctagctttgtctcttccactgaaacgctcatgcacctgatatgaactccaagcagcctcctgaacatattcagtgagcctgacttcaagagaaagccccgaacgatgaggaattaccagcttgcaagacatagagaacccattccttctgaaaaatcattttccttcctgagcccattcacacagggctttgactgtttcctacctgaaggtcacatgcatggccaaatctccatctcattaattacaactcttggcaagccattaaaaatctcatttcattttaccatccaacctccttttaactgacttttcataattataattctatttttgatatactggacctattaaatttaatgccatacagagattttagaactccttaaaaaaagactcaaattggactgtgtccaccaaaggatgtgtagtccttgcttaggaatatgaaaggggaaaactgcagtgcattctattttcatccacagaggaagaaaagtcaagctaattgcatatggtcagtataataatgctgtcattctagaagggctataattagcgagaattgttttcacaaacaaccgaccaagcccatgactccagcttgcattagttcttttttccccaccagttataaacatttctatttttgctcctccccaaacataaacattactccattaaaaatacccagggagaggagatcctgacagtataactgcaaactctgggaatagacataagcctttttgcaaatgttgagtctgttaaaaggattagagtgccaagagagggttggaggaactattatccaacaagctaaactttacctggtaacatcaaggcgggaagccccaggtgaggcacctctcctggacagagaggagtgagcactccaaagccccatgtgaagatgaggggccattgggatctttcacatctgaagatatataaggcaaaacttacttagctccacgtcatgtcgtacagtatggatgaataactatggacaaaattctctctcactttaaactacagttatttaacaaacattatttggacaggaattatgatcagtgcattttccagtgctgaaattcaactaagaaacagggattgttgaattttgtcacactagactgagacagtggatcatctggagtatctagcactgattctctccccaacatatgttcagagtcctgttgctccagcttctataacacactttcttctgtccccactgctttttgtttggaccctccatacctctcattccatcactggttgtccacctatgccaagtctgttccttggtgcctgggcgctccagtcagcatctctaacatgaaacctcaataagaccaaagccactaagaaccacactggctccattttaccttcaaacccattttcagtgctgtcccttgtgcaattttggttctaactgtagtgagtgcttttggtccagggaccacccagagctcccttgacttccctttccttacctggtggtctgacgcctgtcgttctgactccagctgggatgacagctgccacagaacctctctgtgcatctccttcaacaagaggaagggtcttccctgtgcacacagtgtccagaccttgcctctcaggtcctatgctgcagcgttcaatttgtctattgacacatccatctttccactaaatggcaggtgcgctgctatgtcctacactcccagtgcctaatgcaaaggctgccctgatgcaggcacttgataaagatgtgattcaatgaatgaatggatgtgggttcaaagagtggctgaatgaataaatgtcaaacacattgatgaatgaatgaacataagtcattcagtgcaccctctatgttgaaagaaacgaagctggaaaataagacaaagcttgggatgctaggagagagttctttgaactacatttggagcatacctgtcctctatgctatgacaaatatgcctggaatctagaaaaggaggctctaggttgaggcattgaggtacatgatgagataattttctctcaaaattttttgattcaaggagcaaagcactggttcagaccctcttgcaaagacagtaggatgtggggctatggaaaaactcaaagtgaaaaaggtgagcacatacatgttaattagggctcagtccatttcctctcctagacaggcccccagatcctcagcagcagcacccaaaccagacacatacacactcacggacacacacacaaagcaggaataccacagtagcagctcctccccccaccagctagaggctgcagaatatgagaacctggcctttgcagtgtaacaggccaggaatctagcctctgctctgttccataagcaccatgggttcatggactagttaattaaattccttagtttttttcctcagctacataaaaggggaaaaatagtcactttatacaattttataaagactgaatggcatactgtatgtaaggcactcagtaagcatttgttgttggattgctattgtgaggcattgttgaacttgacattgctatgctcagcttggcttggtgtttatccagtagattccctttataacataatggccagaataaaggaatggccagagaaggaatttcctagcataaccagactgaagctgagttgatgataggttagacatctatggaatctgaaatgagtcagtccttcctttcctgaaggtcatgatgtaacttttgcacctataataactattcccctacagctgattttgctggtttttaagtcaaaatttaaccaattccaattaattccgtctttatatttgccaccactccatgttggcttgttaggcaattaagtattcaaattagagtaactctcaaatatttccttgcagaggaaaaacaaagaaacaaaaaactatgaaaaaaattaccctttaaaggcaaaatgtccatccagttttgaagattaagaaccactggggcagaagagggagaatgacctagaattcagaactgcaatgataaaattattcctttgacaacactaggtggctgattctcctaaggttgtctaatagatttaaaaatttttgctatccttgttttatggaaatataatgagaaatatagacatggttttgtttagtttttaaattcaagataaacaagaatttcaactgtgacattatctctcagcaatagcctttgaatctcttgtgttgttcaatgaactactcactagatgaaccactggcctttgcaggtattaacctctgcagtaggtcatcctacttcatctgtactgttagtaaattaatcaaaagctagcatcaggtatgcacacacctgcagagataatgtgtacagtgttctccagagggatgggatttgattctgtaggtgacactgatggaatacagcagtcagggtcttaagaaattggatagattaaatatatcacaaaagagacattttaatagtctaaaaatcagtaaaggtgtttttcaaaatacatataattgagaaaatatacactaccctaaagagagagtagattatgagatagagatgcaggaaagaactatctcaattgtgtcccccaaagcaaataaatttttattaagtccagtaccttgctttttaaaacaacacgatagcttacaaaagaaatgaagctttagtacacactcttggaaataccttttcagatgatggtgaaaataataaaactgcaatgaaaataatgacacccataataggacacactgggtgcatacaatattctcggcactaggctgagcaacacagtgggtattttacatacacattcctgaatccttgaaaaatccatgaagccatgtattagtacttacattattcatgcaagaaaactagaactctaaggaaaagcaagaaacacaaacgattcttttcattttataattttctttatcagtctgtgatttatcttttgaatgcctgattttctatcttcttcatcctaggggagagagtattaagttctttaacagcaaaggattaaaaacatagtcattctctccaccaagatctataaagtattttttaggggcataacaataaataagacagaaatcttgccctttaaaaactcaagtctggccaggcgcagtggcacatgcctgatatcccagcactttgggaggccgaggcaggcagaccacctgaggtcaagagttcgagaccagcctggccaacatggtaaaacgctgtctctactaaaaatacgaaaattagccgggcaagttggtgggcgcctgtaatcccagctactcgggaggctgtggcacgagaatcacttgaacccaggaggcagaggttgcagtgaggcaagatcatgccactgcactccagcctgggcaacaaagcgagactctgtctcaaaaaaaaaaaaaaaattgcaaacaacaacaacaacaaaaactcaattctatgcagcatcacatactttcttccttaaaaataagacaaagacatggttctgttatacagaaaggagggaaagtgatgaaaattataccagcattaccgccattttttctgtgaggtaggactgagtcacatatatttttatatgttgtgagttctagataaatacttaataaatgtcttactctgggtttaaatgtgagttaatctgttcctccctatgcatcaccttctaagagatttcctcagcattttcatccacctcataatgctctttctcactacgtctatactctgtctcatccacatcatgatcttttgctctgaccatattgatgctactaggttggtgcaaaagtaattgctctttacctatgtatctctttaaacactttcaagtctgttgggagttggtctattttgcggatctagggtccaaattctgtcactgattgttctgctgatgcgcttagttccattcattgtttcattagtgggtaccctttgacttgagttcaccatcaccaagaagctgtgtttacaagagccccaaatccagaactgagaacactgccatgggcatgaacactagagggcgctctcaaactcgaagatttggtgttaaggcccctgctggcaaggaaggttcttatttgggtacctcgtgggaacctagaaagcaggcttgaggccccagtttcgtcttcatgagacaatgtccacccacagccatcttcctcttctcgtcttggggggtgaatctgcggttcttttgcgttttccttttgcaggtagaacagctcactgtagcttccggattcagtttctggcctccctgctcatcaggctcaagcctcacctgcttctcccatccctgagcatgtttataagccccagcccccagaggcatttcaacttgggttcctactgaggattccagacttgacctctcttttttatttctgtcccctggaactgtccctttcttgctttggggacgctattttttaaatgccattatatgagggtaagagatttcaaccatcaactcggcctactgttttgctggaaatcttacaaaagaactatcttctgtatgttttcacctcaattccagagtaactagaaatactaccctacgagggcagagacacttagtttgaatgcgattccaatgttttcatgctgataaatatgaacattttaaatcttaagggaagataggtagttttaagtccgtcctttcaattttacacctgcatttaaaaatataatttaaactactatttaaccattaattatatcccaaaaaaagaggatatgaaaacccgagtgaacacagttaatgtacttgcccccatggttttgaaacccagcccacacacttcccaaactctgtagtatgctctcatgtctagatgaatatcaaatgtaagatgatttctatggttaggagctgagttgaaagcagaaactctttagtcttcaactacaagtttcatttttttatgtgcaaaagtgtctatctgcaaatgcacaaatgagaaacaacagactggctgaaaccattcagcaccacacctggctcctagggagtgttcaggatttctcagcgactgcctcacctcagcataatatttgtaatgcgtcttactttttacttttgagtttatttctttgaatagggtcaggaaaatccattaattaaagattccaggactctaaagtacatttcaaaaaagcagaattgttcatgagatcttataaccatcctaggttcttcggatattactttgtgtggttatgtggccagaggagtttggtctcagactataaaaggcataagtctttctaatctgttcataaccaaatatagcacacaggaaatcactgcaaagcgctgatataatcttttctgttttactccatctgaagatggttcctgcctgaaccatgcacactaatcatttaatgttctacagaagaaaagaacaaacagagcagggaggcagatgtggccacatactggatctacacttaaaacagtgaatggctgctacccccacctcctgcagtaggtaagggggggtcataattacatggtggggtaggaatgggtcaaaagcaaattgcctgagtgagagaagttctagaaggtcacatggtgagactggctgaaaagtacctccagaactagcaaatgttttcacttggcttgaagtcacagaaagagcattgcagcataatagaattacacatcctttgggagatatccttctctcacttggagtgtgaaattcttggtgatatcaaccgaagctccacatagttatggaggtaaaggaaactggaggctttgagaattacaaaacataccacagatggaatattatccaactatatttcttgcctcccctaaacatcagttacacggttctgtcaagagactcagagctgccaagggtcagttgctcagttgtagcaaaaactattttcaattcatggaatggcatgactaaatcaaagaaaaataaaataaaaaggcatttcaagtggccagaaaacatggggcatatggaagtaggcaggcgatgaggcaggatgttcatgggagaagcacagtatttcattagctcctttaaaaaatgttgctgaagaaacctggggtgctcaaatttggctcagaaggaaggggaagtcttaaataagtatagtaatgataaacacatgcaaagttcactataatcttcccactctttctttccttgctaagttaatttttcttatagcaggcatctttaacaaccatgtaaatttattattttcatatgttctttctttattctctctaaattccaaagattgcccttaagagctttcaaaatctgaattaaatcagagaagacattgaacaattttgtgcagacacctttgagagtgaagaactatatcttataaatggtgtgaataatgcctttggcccttaatacaaacttattttatagccctgaatgtaattcctactacatatctatattagtcaggcttcacaggtctagatgaaattcttttcatctaatattttcactgaaggagcatagcttttattcacaaggaacatcctaataggattttaaagcttttcccaatgagagatggcttgcttttatcatgctccttgaggagaaaaaagcttaagaggtttcaaataaacagcttatcaatatcaaatattatttaatcagaccaaagacatagttagattaaaattataagaaggacaaattattgtgcaccagctttcataatttttaattataatttctacaattttataacgtgagttatttgaaaacatacttagctattcctaaagagagtcaaattcccattgttcatctcaaaagtcataaaaagcaccaacagatccttccattctcccaaacttgttgtgactcatatttttgaatttcgagtcattcaatgtcttctaaaatacaaaaaatatattaaaatgaggaattatttattttcttctttgtatctcagaattgattgggaataatttgcaagggttgagttttctgtttcttgtcaaaagagtttctgttcagctatttaataaaacatgtattgagtactcattgttcagaaagagcccttatgtaaagcacaaggtggagtatacattttatttactcaccagggttttatcacaggggagacagacatattccacaacacatatataaggatacccatttctgtgggcagatgcattagaaaatatacagaactgacaacacagctgaggagaaagctaaactaccgtagtacggatcttccttgctaacagaacctgattttgttaaacaaccagggctggagcaagggcaaggctagtaagtacctcatttggagtgtaaaatttcaggggatcaaaaaatttcagtaatcaagataaataatattttaatataatatttttcaaggtctagattaatgcaaaaatccaggaggagcaaaccatcaacattttgaataaagaccctggagccccaatggggctcggcaggagactgtactgatcctgtctttatttaaaatctagagtgctgttcatcattgcttgatttttttgcattcagatagctttttaaaatattgcattagtatattatttatcttgattactgagtgtttcagcaccatttaaatagtgtacccaagatgagttcctcactcacctaatcctggtcccaggcctgctggactcaggacataaatggtggtttttttccattctcccttgccagacacttccttttcaattacacctagaggcagccacacaaatagctctggccattcatatgcaaacaattctgcacatggcttcatgtaagatttggcttttgttgttgatttctgatactaagcagagagcaaagaagctggttgcccccaccctcccactactgcctgtctctgaacactgccagcagccatcctaacatgaaataaaaaccaagggcaagagccaaccccgtgaggattattgagcaaaatgacagcacttgggtccttgctgccactgttgagctctgaaccagccctgcactgcttactctttgcatctagttaggagacaatgaacatccttatgatataaaccacaattagactaactatctattacctgaagtcaaaatatttctaatggatattctagcttaatagccagtgagctttcggggtaagggtttctaaactttactgcactgatgacttaaaacatgtatgttaatatttcatctctgaatcatttgcttctaggtagtgaagcagtgcaaattctcaattggaatatggctgtaatctctttatatggcaattaattgtggaaatgtatgcaaattggaggtcaaaccatcattcaaataaaatatactgattttttcctactaaatatttgtgacaaaaatgccagtgtcaataatgtcaacagaaatctccatttttattttgctcctgcaataaagaattctttttttttttttttagatggagtctcgctctgtcgcccaggctgaagtgcagtggtgcgatctcggctcactgcaagctctgcctcccgggttcacgccattctcctgcgtcagcttcccaagtcgctgggactacaggtgcccaccaccacgcccagctaagtttttgtatttttagtaaagacggggtttcaccgtgttagctaggacggtctccatctcctgacctcatgatccgtccgccttagcctcccaaagtgctgggattacaggcgtgagccaccgctcccagccacaataaagaattctattgtgttgttgtttgaggatgaagaaaggagggaattttcctgaagagataaagaatgtcccaaatgtcccttatgttcccttatttccctagtttcaagagcaatagaatcaatgtggtaggaaccttagatatagtagccctatgggctcatttttcacttgaagaaattgagatgaaaatggaacacaatagattttctatacatcagagaagcagttaacagcagattcacaacaattgcacaggtttcctttcctagtctggtattctttaaacatgaaccatgatgctttccaaaaaattgactcagagaggaggccaaggcacatgagtctctgagcagaacagcctacatcgatcttcgttaagtgatgctggaaggcaaaggtctataattatgctatccaatatagtagacactggcaataaatgactacattttaatttaactaattaaaattaaatacaattaaaacgtattactttagaagtaacatttcaatcctcaacagctacacatggctaatggctaccatatttgtcaatacagaatatgagcatttctatcatcatagaaagttctattggccagcactgctttatagccatgagttctcttattgttctgtttctaattgtaggaacaggaagaaaggaaggatcacctatagaaaactcaccctgaaaaggtaaaagaagaattgcatgcattactacaaaagctactcaggctaaatatgtatctctcttatttcctctccatggttaatataatatctattattccaaaaagtatttttatcacttaaattcaaaagcaatctgaaaatcaacaattctcaaatgtgatggcacctctgaaagtggtatactcagaaattttcctccagactgcctttgggagttaaataaattaactttcttatgccaagttaacatgaacttagcccttaaaataactttgtgaggaaaactttactgataaaacagtctgatatagtctggttgtttcttctctccaaatctcatgttggcatgtggtccccaatgttgagggtggggcctagtgggctgtgcttggagaatgggggaagatccctcatgaatgatttggggccctctttgccgaaatgagttcatgtaacatctggttgttaaaaaagagtctgggacatctgccctgtctctcttgctcccgctcttggcatgtgatatgcccatacccccttctccttctgccatgagtaaaagctttctgaggcctcaccagaagtcaagtagatgttggtgccatgcttgtacagcctgcagaactgttagtcaaataaacctcttgtctttataaattacccactctcagatattcctttacagtaatgcaaaatgaactaagtcacagtctatggtgggttttcattaaagataatcttggatttcaagtaatttgctgaaacatgtacacacacatacacacacctaggtcttattaaatgttacataacacattattcagaattatctttcacattgtaaagttctcacataatgcttggacgtgatgcccaaaaatatgtggcattgtatcctaacaaactcaggctatttctaaagcaatatgattactggatttgacactctcgacaagtttatgcatcctcatttgagttgggactaacgtaatttcaaaaattggtttcatagaggtattatttaggtagaataatatttactcatttaaatgtaaaatttaatgacttttaacaaatgtataaaacctgtcaccacctcttcatcttgatatagaatatttgcagcaactcaaaaaatctctcgtacaccttgcagtcaatttcttccttgaccctatatccaggcagccattaataggtattctgctgctacaattctatcttccacagaatgtcacataatgagataatgaatacatattcttttgtatctagactctttcatttagcatgatactctgagatttcatctagcttgctatctgtatttgtagtttgtttcctttttattgcccagtagttctccattttacataattaatttattcatttccattgatgaacttttgggttgtttccagtttggagtttttaagaataaagcttctataaacccttggatacaaatctttctgtagacattattcaatattatgttactgttgggaaaatacctaggagtgaattttctgggacttattgtaagtatatgtttaacttttgaagaaatgtcacatttcccaagtggctgaatcattatgcatcatcatcctgcattattaacaacaaaacaagaggtccagttgtgccatatccttgccaacacttggtattgtcagcctttctaattttagtcagtctgcagtgtgtgtggaggtatctcactatgcagttatgtctaaattgctagtccatttttaaaaattagattgttttcttaagttgtaagactttatatatgctggacacaagaccacatatatatatggtaaatatgtgtatctctgtgtgtgtgtgtatgtatgtcaaatattttgcaaatattcccacacagtgtatggcttgcttatccattttcttaatggtgtcttcgaagagaaaatgcttttcatttgaatgtggtccaatttatcaaattttctggtatgtgcttttcatattctagctaaaaaatctttcctaattcaaagttttggaaatatttcttatatgttttcttccagaggtttttaaatttttgctcttaaccttaggtctgtcatccctatcaggtaattgttgtatattgtgtgaagcaatatttagagtttactttttgcagagagatataccatttttccagtaccacttgttgaagactactattttctcattgatttaccatagcctcttcactaaaagttaattgacaatatatatgtatatgtgggcctatttctgatctctgctttctgttcattgccttatagttttcctcatgcaattacatcattgttttgagttcttgtagtgtaggtcttccaacatttccctgcagaacaaaccaaaaaaaaaaaaatggcagtgcaggagcttagaggcatacctggttatcattatgaaagttccatcgctgatggaacatgtgtgattagatgaaccccttccttcacttaacccattccctgccttatatttttcctcaacccttatcactatgtaaccaattctactacatgtctatatcttattattgtctgactctcctaataaaatgtaaactcagtgtgggccaggatttatttctgttttacttcctggggtaaccctagtaactaaaacaatttctggcacataataagcactcaataaatattgactgaattattaatgaactgggcctctgctttcatctttaaacaagtaattctctgtgctgaagccagagaattgagtggcacaaaaaatcaaacatacaaatgagaatgacaaccgttaatcaccttctgagagctgccatgagcactctgctcagccgttcctggcgtcagggtcttgcttcattgattttagttagcagggtttgcagcctctctaaggcacacccagacatattttcaaggtaggatgggtcaaatagtgttaccccgactttttacactggggattagaggaatccattcattttggtgctttagcacacaacatcactgtggatgacagcatgagtctggcaggctcttaatcatgaataagaacactttctcactcatggaacatgtgtgattagacttgcccctgagtcatatgaaggaattgggagagcaaaagagaaattaaagaataaagctagagattacctcccagcctctctttagtcaataataaaaaagattcaagaaaatacaaatttaaagtgttgattaaattaaaaaccaaagtaaataagatttggaaaccttcatgcagtctttttctgttgttttgttggtaacagagagacatcaccactgctatccactggagatggcataagctttgtctcccaaatgtaaccaaggtggcttaccttgtgctgatataaagagaagaaaggaggacataatccaagaaagatactgcctaattaaaactttactcaccccacatttaatctccaactcttcctctgtacataaaataaggatttttatctaccttcagtatgacaaacagatgaattgcccatttaatgcttagaaagattataatatacttaaagatagataaaatacaataacgtaccatttgaggccaaatggaaacactattttaaatcagaattctaacagtaactttacaaatccttattcccagttttaactcaatcaaattgcacaactttacttacaagcaatccactcaaagacttaaaataataaaaactatctccctattgagataaatcaaccaaaaaacaattgaaattttacctgaagataaaatataaatattcaatcttataaattatttaattagtggccctagaacgcaaaagtaacatgaaagttattaataattttcaaaactcaataaaccattttcgtcagtctaattattgcttataaaaatgcacaacagggaccctctcaggtctcatcagccaaagatcaataacaacattaaagtccagtctaagtattagaaccaattctctttgttaataacttatagtggttacatgctgcattttctcctaacatctctgtgcactcatgaataattattacatacctagattatagaattgaaaagtggttttttaaaaatatttcatttctccagatagaaaactgacaatatattttaaaatcagaaatgtatcccaaaatgcattttgtaatgtaaaaagcaggcaatgtggttataccttagctggttcctttgcaaatagattaaaatattttgccaatgtgattttgacattacatcacataaaacatccagtcatatgcatgataatgaaaagacaaattattcatggaacaaaggatatttaaggatccataacagcacgtttcctccccaagtaaactcttaagaggataagtcatatcctattctgaaacaagtgaagatcacacttggtttatgtaaattttagtttacagagaaaatgttgagttcaagacagttttcaacagttagcagtgtcttcctatatgttaatcagattcatatgaaaatgttaaaactaagtattaaaattaatgtcatgctatctatttctaattaaaataaatgttcttaattcctccttggagaaagtaggacattatcatgcaatcacacacatttatgatttctaaaggtcacagtggtagatctgagactagatgaacagagagaaatactggaagcagttttacccaagatttatatattcagactcagaaacctctggaatctcacagggactcgaggaatcctctactgcagcctgtcctgtggcaatgaggttgctgtatcctaatgaagaggctaaactcagccagtaccatgactccacacaactgcttggtgcattagacaccagacagccaaatcccagagaagaaacagagcatcatgagacacgcatggagccatgggacacgcatggaactgtgggacacgcgtggagccatgcggcatgcaaggagatgtggacgtgcatggaaccatgggatatgtgtggaaccatgggacacacatggagccatgggacatacatacatggagttgtgaacatgcctagaactgtggacacacatggagggatgggatatgcatggatacatggacacacataaagacatggatatgcctggagctgtgggacacacatggaaccatagacaagcatggagccatgagacatgcatgtagctgtgggagacacatagtgccatggcacatgcatggagccatgagacacacatgcatggagccatgtcacacacgtgcagccatgggaggcacttagatggcacatagagggagacatggatatgcatagagccatgagacacacatgcacggagccatgtcacacacatggacctgtggacacacatggagcctagcacagaaacatctccttcactcatccagcatgccttcattttctgagaggttacagtttgttgtaccttgacactgtccgtgttacgccttctccagccgcaggaggagcaggtggcaggctgagcaatgccagtggcccacaagacagcacggggtcaagggaagagtgacaggaggccagaaaacaggcaagaagggcagttatgatgacaacatgtaatatgcacatggccacattagagaagggcagaaagagcttcttagactaggagaggggctgggggcacagtgagtgaatacgagaaagagccaactcagagttacaaaacatgtcagatattcttcctgtcaaaatttaacaaagcaatgcatgcaacacacacataaatataatgtaatataatgatatgttttgaaaggaaaatataggatccatgaaaaataatcattcatactgtgatatgggaataaaacccaagtttaaaatcctaattggtcactttcagtcactgttttttcaatcatctaagactacatatggggataaaggcagctgttaaaacccaagttccttagggaagcagcagaaaaccaagtgcaaccccctagcccagtcccggtgatggcccaagctggagcagtcatctcaattccctccatgcccttcccaagccactggagctaaatgttgcaaatcctctatcacgagtccatgcagctcttgcttaagtttcagaacaattctcaggccaatcaataaacccataagtaggaggacactctacaggaacattaaggagttaaagataaagatcgctgggacctgggaatggaaatcaatagggccctgcctgattctgcaggcaggagtaatcttaggcattaatgctaaatgctgccagctaacaccctgaagaaaggcctccaaatcagtcatatgaaggacccacgcaaagtacagcatgactcacatcactggtggtctttctttgtgaataatgtgaaattgcttcccacaaaccaattcctataacaggagcatgctctctaaatagccagcatactgagtaaactttaatcaataaacaaacaaaagcagaatatggcacattgccttaagtagacattaaacatttaaaactaatttcagagatggttttgagactcagtaagcatgctgagaaacatgctgtcttgaagggtcactatttttcccctctttattggaatagacatttaaacaaatgacaaggacatatgtgtgaacggtgcatctgtaatgggtcagggtgttttagcagccactgcacaatcagggctaaatattccagaacacagagtcaggcaagtaaccttgcaaacatagcaagctgttaaagcgtgttatgcaatgaactccactagacaggaggagcctgcagtggcaaatatttcacagaggctggaaaaaaaaaaagattctaccagcatcttctgcctagccaggtaaatcagatcaagactctgacagaacatgctaagttgcatgaagacgttccgttaccatccagtccttcatcagtagcatcctatgcagaatgcctccagtgcataatactatctgcatggaaatcaggattttaagtcaagattatccggttctccctttatttccccttagtcagtgtttcatcctactttctcaaagtttcttggaatggtgccttacaaaaaagcgttcacggggagtcgcagagaccacttgttcagctgtaacatgagccatttcaaggcctgactgggtgcataacatcacaagacatcgtgtgtgtgtgtgtgtgtgtgtgtgtgtgtgtgtgacagagagagagaaaaatagttttattccctcctcagagaagcacttcctttctaaggccctgtactcttggcctggggcctgcctacccctcttcagccaagacagagatcttcaggaactccttcctctcccgcacccacccccacccacaagctttcctgcatcctgggtgctttggcctcctgccctccaggctcactggaggtggagttggcttcctataactttactgggcacctgttcccagttgctgtgccctcctacagcaccggggtctctgcttaaacaatcatctcccctctcttctctctctttagcctcttccttcacctcattccttcccatcgccatttgaggatggttaagtcatgctctttgaaaagctgttccctgccccttatgtccttgcatgactgacatgaattctctccttttatatctatcatctagtccctaacctttgatatatccccacacatatcaccatctggtttcttcccccaaccctgcactgaaactgctccgataaatgctgccttttatgtgtcctcccaaaagatatactgaagtcctaaccacaggtacctctgaatgtgaccgtatttggaaacggcacctttgcagacaaattgtttaagatgaggtcgtactggattaaggttagccctaagttcaacatgacttatgtccttataaaaagagaagacaaaaaggcagggacacagagggaggataccatgagactacagactaagagactggagtgatgtgtccatgagcaaaggaatgccaaacattgctgacaatcatgagaagctaggaggaagcagagatcggttcttctctagagacttcagagagaacacagacctgcaaacaccgtaattttggacttctggcctccagaactgtaagaagagacaattaggttgttttaagccatctagtgtgcagtaatttgttacagcagccctaagcagctaatacagtactgctgacagaatttctcagaaagtgacgaattgtcctggctttcccagaacagaagcaaccaggaaagtcccaggaagaccaggacaagtgtgtcactcttccttctggcatacacctgccttgaacactctgcagtatctgacgctctgctggacatagccttcttgaaaatatccccattcttggttctcagaaaggcttgccctcaactagataattccatctggtggctcacaggaactcagccttttccatctaaaatcaccacacccctcttatctgctttctcttcttgattctatatggaatcaacagccaagaatgtggggattgcagtcagggcttccttctcattcctgctctacatctactgaatcctcaaccacactcctttccaatttccagaatctacttcttctctacatttctgcctcccttcccttaatgcagttcctcctccctttggtctcagtagcagcctcagaatgggctgtccctgccggcattttgtcatcctccagataaaggataaacttattcagatgacttccaatgccaggcacctccgaatccccacttgccatgtgagcctcatgccctccacctcctcctccatatcgtaaaataagatgtcctgacttcctgtgcgtgaggcttgccaggacccgcaatgctccctctctcacttcagggcttatcacttgctcttttcctctccctggaaacctctcctttcataagttttgtaaacaccttctaacaatcacttgggatgcagttctggcatggcttcatcctagaaacctttttcaaccaccgtcctacagcccaggatgtgggcttagagcccctctcctaggctctgcagcacccaacacaggcacctgttaggacccttcacagaatattacgcaatggcccttttggttcacattcctaaaaatagtctaaacccttttaacaggaactgagcatcttcttgatctcctcaatatctagtaaaaaccctgtacacaacaggcttctcttaaatgttcattgaaggttcactccgaattaaaaacatgcaaataaaaatacactgagatgccatttatgcactgagtttggtccaaatcccaaagcctgacggtgtactctgcaggaaaggcggcagagaaataggtattcatatccagggcaactagaatgcaaagtggtgcaacctctatgaaagagaattgggcaacatttacaaaacgacatatgcattcaccctttggcccagaaatcccaattcgaataatctctttcaacggtacacttgcaaaaatattacataatgtttacaggaggcattactcactgaaacactatccatggtcacaaatggcagaaaataacctaagcatctctcagtaaggtgtttttgattaggttagggctcatcacatagtggaagctatgtagctaccgaaaaaaaaaaaaaaaagaatgacatcaatctctacactcttctagagagtaggctccagcatatatcattaggttaaaataatgttacacagaaacaagtctatataattgccacctttcatctaaggaaagagaacataaatatatatttgtatgtgtgtgtgttgctttgcttctattacaaaagtagcctaacccataaaatataggtaaatagctaaatgcagaaagagctctggaataggatcaagaaaacaggaagcaaagctagattcctttgaacaccttttgcttcaataattaaacaaatgatagtaactgggtcttgggttggtgccataaccacgcagaaagaaattatttctactggttttaaagcagtaattttgctaatttcactaaaattttccagtgaaatatatacgcgaggacaaaaaaaaaagagagagaaaaaagtcattttaaagatttttcaataatccaaaacaactaggtttgcatgaagctgttattctaaaatgactgtgtactaaagaaaaaaggcaaagaaataattaggttggtcagcagagacttgagattttgtgcaaggaagaaatagacactaagatgggaaaggttaacaaagaccctagagtcctggagatgagttgggagtatcaggagaagtttatggtatgttttaaaaatgcttttgttagcactgtccactgagaagacctgtgggcacctttggtgctcaaagcatacagaaatgagtgattcccaggtctgtggaaggaaataagtaaaaggaataggaacatcttgtcaacccagagagtaaagaagctctcaaagatgacttggatggagtcagaagagtccagaagctgctctcaagaggctacactgggcttaaaatgctataatttcaccatgtacaaggatgtaaactacatggattaaaatacatcaaatatgttgaaattcatgtattaataataattataataatcaaaataagaaaaaggcaaacataacatcttattcatcccctttggatgacaaatgaatgacctgtgggatgttaaagaaccaacctacttgtgtatttaaaaaaaaataaaagtataaattgatggggggcggggaacatttattttgcctttcctgcataaggtgtaccttcaggatacgtaaagagttgatgaaggaaagatagtttatatagaagtattctaaccattaaatgagcaaaataataaaatgagaaaatcccagttttgtacccacagatgaatcagtagattgaggctgtgatcatcaatgactgatcatttcccagctggatatgctctgcctcctgaaggaaatacgctgcactacccatgacacggtcaagacaaaaagatccaaacctggatctcagcaggtgtcttgagattactaggaatttacagacatctttggaaagaggaatatttgaagcacacaatcagaatgcgatgagcaaactccagactgtgggaaactgtccaggacaaagaacttggtttctgtaatttgcaaagggtgtgaaataaaagtaaaatattaaaagagactcaagaaatataccaaccaatggcagtgcatggaatttacttaaatctcgatttgacttaactggccaaaagatgccgaagtatttatgaacccatgaaagatctctcaatgccctctgggtgcttgatgatgtcatgaaatcatttattatttgtttgtttgtttgctgtgataatggtactgaattccttatctttgagtattatcaactgaaatctgatggataaaattatttgatttttttttaatttcctccaaaataatttaatgggtatgagatgaagcatgagtggaaatttagatgaaaaaggatggggatgggccatgaattgataagtgtggggctgcatgctccttagactattctttctttttttgtgctccttagactattctttctatttccatagatatttgaaagtgtttgatacaaagttttaaaaacaacaaaatataaaaccacttgttgcatgaattactgaaatacaatgtctcattcatcatatttagcctgataatataattccttgaggacagagatagagtctattttcttttccactctgaatgcttgagtgccccgggtgtgaaggaccttaaataaatttcaatgaatgaaagaataaatgagtggatatacagattaattatttaatcctaccaatccatagagatacttgggacattaaatcaattctgctgccatgcaatgctagatagaaacaaagggctaggtttgtggcaagactaaggctttgcagggaaatgccatagtgaagaattttaggctttccttggttttgttgttatttttatggtcacatttttatcctttggttcaaacacttaggaggcccacagtacctgttaaataaaggtgaccagaaataatgagatttttttaccttggtaatccctgtcttagatccctcttgaggtggtaatcagtttctggatatgaaattctaatgatagaggcttttgtagttttacctttattttaaactgtgtctgaaacaagagccactggattatacagcattcgtgatgctctattatcttctatcactaaacacagaatgtgcatttagatgacggctttgcaatcagtgcgtgctggttccttacctttataggagatgactggatgctcggttctctggcactgagtcgtaccctgggcctctgggtgggcgagtctccacagccccaggcttgagaacagccatgctataacacaggttcccttcatggtgggcaaggggcctctgactctgggcacgtgtcttctaaacagaagctcttcttctcctcatgtgtggaaagtgcctaaaacacacaaaagagaagaatcagatgactgtgagttcgttttctggtgggtggtcttctggtaaaacttcctcactaactttaaggttacactttgtggagatagaggagagcttggagggcttagagcagcatatttttctagtcatatcccaggtcgtgtgtgtgtatgaatgcatgcgtgagtgcgtgtatctcaatacagacctctcattctcccaataattgcatgacatagcccatttgttttaaacgagaaatgctcaagcttaagctgtactgtcgtcacactcactcctaaggaatgcagattaatagttgggattggccggatttcccttggtcacctgtcctaaccccttgcgcaaacacaggtctatatgtggaaaccctacaaatacctgcccatccctttttaacatttaaaatatttagttttaagaaggccacagccattgtcttttactaataaattgatgaatattatgctgcccaactttaaaaaatcatcacgatttgctaaattctgtatttagtgatgcaggataaccttttaaaattgtagataatctgcctgcaaaatatctggctagagatcaagtgtgaatcaaataaaatctatatcgagcacctactgggtgaaataaaagtactatgcttggaaactttaaagattatgaacaatttaaatgattaacaagcattaaagtaatacaggcctgtaaaaataactataatccaagctgttagcaaacctcaaaaagaacaggagtgctgtgggagtcaagggagaatacgactgctacagagaaggatctatgacgggtccatgcaggggctcaaatctgagtgtaatgctggaggataaagaggatttcaacagatggaggtttctggaaggacgttccgtccccagggaggaggatgaaaaggcacattggaggggcaagaggaagaggtacgcaacatgttttaggaatggtgtgctgtactcgatctaggaagtttaaagggaagtattgggaagagcttacagagtaggttaagatatggaaggcaaactacactaaggtgtgaggtctttattttcaggcaacaagctaccatagtacattaatgttagaagatcttattaatattaataagaccattatcacaatagtgtacctaggaaactaggcagatgagaacatagaaatggagaagtcagtttgaagccattacaattgttaagaagagaaataaatgaagcagtgactttgagggtttcaatgtgaatcaaaaggcaaacatagtacacaataactgtgggtaatggaaactacggcaaattagagatggccacagattcgggcattcctcccattgagagctggatctatgttctccacctggaatctgggttggctcagtgactgctctgctcgctctgctcattttaatacaacagaagtcatgttgtgctagtttccaagcccaggacctaaaagcctggcagttgctacatcctgtagcttagaacacattctttaagacactgagacactaggtcagaagtccaactaccctgagatggccatgctagagagaacacatttaggtgctatagttgatgggtcacacatgagcccaactctccagccatgagtaaagctgaaacccattgagtaatttcagtagatactatgagagcaaaagaatctctcagttgaaccctgcccagattcctgaccccacaaatgcaaaatgtaataaaagagtggttgttataatctgctacatttggggaacacagagcaaagagacacagatggacttaagatagataatgtaagtgacttcaaggatagtgatgccattcattttaataggataaacagcagatggattttgtttagatgagattagaatcattttgtgtgtgtgtgtgtgtgtgtgtgtgtgtgtgtgtgtgtgcgcgcgcgcgcacatcaagtttcagacacgtggccaggcatggtggctcatgcctgtaatcctagcactttgggaggctgaggcgggtggatcacctgaggtcaggagttcgagaccaacctgggaaatataatgagatttcgtctctacaaaaaataaaactaaaaattagccaggcatagttgtgtgtgtctgtagtcttagctacttgggtggctgaagcaggaggattgcattagtccagaagctcaagtctgcagacagctaagaatgtgccactggattcctgcctaggcaacagagcaagactttgtctctaaataataataataaataaatgaatacataaaagagagaggaactggaagaaaatccagagaaaactgaggggaaaagctattagggtcccaggaaagaaagtgaaagaaaggaaagaggccttctttaaaaaggagtgcttaccacctgaacaaatggtgagatttcaagataaataaaacatagatttgagggtgtatcaaatttcactgtctgtattttttgagtcaaacaaatggggaggaaggaaaagacatgataattgaaattttgaaattgaagagtagaaaaattaagggttaatttcatggaagttggctcaatatgaataaacctgaccagaaacctgaaggtccagctgagtttagagtctctcacccactcaatatttactgagtgacaactgcatactcagctctatgcatgtatgaatttgcaaaggaaccaagaagcatgaggtaaggcctattgcatcgataagcagcaaccatggagttgatataaggaagccaagtacagagtcaccaggaccaagaacttcagagcaggcagaaggttgaggtccttaagaatggaaggaattctacaacattcccattgaccaaaacattcaggttgggcagagaaacaggtaatggcactgcaaatcaagacaagggaagagtatagcttctataggaataagagatgctgagcatgaaggtggggatgggctagggaggaaaacagagagccagaggctcatctgtccgccagcccacaatccctgcccaagcacagagcactgtaatggacaatggatgagaaaatgctcattgtccctggattataacattaaaactatgagtttcacttttgaaaaggagttacagtgtgcaaaactggtgtctgctttagaactccagtccaaaggtaacaagatgaagtagcctatcttttctgagcttcctgatctgagacttaagatatgaaatgttatcaaatgatgtatttcaaaataaaatagcacttgttagaggtgctttagatgtgatttcattctgttaaaagcaaggaggtttggggcacccatatcagttcgggtaaattatcacagtcccacatcaaaacagatcagcaatgataaagataaaatgggaaggatgatgaagtggcaatcaatccttaatacatgctagctctgcagtaagcatggtgccaagcactcacacccatgcctggcacccaacagccacccagagccatatcaatgataagtccactgtcacagagcagcaagccatcatggagatgggttggagcactgccctgtcattatctccaagaatgagtgcaaatcaactagggactaagagcacattcttttcttacacatagtttttcaacgtgcacatctaagccaacatagattccccttctgctaccgatgaagggcatcatccagacctgcttgtgaccgcaactgtcctttatttacaatatgccctccactctgatcttaacagacttgatgttagaagccctaacatctttgccacctgaatgaaaggaagagaaaaataacccaagtgtctgaaatgctctttccttgggatttggaaagcgacaattagagaagaggggaaatgacacatatagagaatgagcagctaaaatggaacacgtagttcaagggtgatgagctgaaatgacatgtttgtcatgttaggaaagaacatttaatgagaacaggtaattttttgaggtttataattttcagactacaacatagtaccttttttcttaaactaaaggtactgtaaactgtcattacagtaaggtgacaggaaagggcattcatagtcttcatgcagagacgtgggcttttttaagcaacttaccatggaaggctaactccttgaagaggcttttactctaaatagactcagctctaaatagcaggtccctccttcccggactcagcaggtccatattccactgaatcatggagctcttgcctctcagtggtgtaggaggaacacattcataccagggcttttagtgctcacgctcagcactattgatattttagtcatataatcccgtgttctgggctattctatgaaattagcagcatccccggcctgtacctactagagctagtaacaccccctcccaccaccaactttgcaccaaccaaaattgtctctagacaatgtcaaattgcccctggttgagaacctctgctatagatagatagatagatagatagatagatagatagatagatacatagatagatagatagatagatagatagatagatagatagatagatacatagatagatagatagatagatagatagatagatagatagatatagatagatagatatagatagatagatagatagatagatagatagatagatagacagacagacagacagacagacagacagatgcatacatacatctgcatatgcatacatacatagataacttccctctttggaagttaaacaagctgccatgacttgaaagattattcaaaatatgcttatataaaacaccaaactaaatttgtgttgagtcattcaggcaaaatttcaagatatatgaaattcctgttaattataactatgtgctacatttgggaaatacattatgaaggaattttcaaaggatcaaagttctatcatcattcaaccaactctagaaaaataaaaatatattacgtgagttaatatgaaacaaatgaatttgccaatatgaagatttattctagaaagccaatttgggagacaacatataagcatttttggtgcgtctacttcaaaacccctgaaacccctaaacttccttttattttccagatgtaggaggatatctctataagctcgatctaaataagtacaactctgtatagaagtgtttgtgcaataaataacatttctcattcactcccacgctacaactgaaactgaataggctttggggacagaaaataactgctccttttaggaaaaaaaattgctgtcagataaaaaagaaatcaaaggaataaaagcttccatgaggcattttgcttagggaacagtgtctaaccagttattagtaaaaacagatccaacataagcttaatgtacttttcagaggaggctgggtttcttctgagctataggcctatcataaagatggatatagcctaatctgttggtatagtccagagagtccacaaacccctcctgcgcccatcccctacttgatggcattagagacttgctttggcaaaaggacaaaggagtcaggtgagtgagctgacctagtgaggtggcctcagagatgtctcaggaagtcctgtcccatgcatgccacagcaggacaatccttagtaccaaaaggctgaagcgattgctgcatgtgtgtctcttaattaggaacagttacagattgtcataatgtaaaaaaacaaaacatccaggatttgcaggagaaggagttggaaagcgcttttttttttttttttttttgagacagagtccagtctagttctgttgcccaagctggagtgcaacggcatgatctcggctcactgcaacctctgcctcccgggttcaagcaattctcctgcctcagcctcttgagtagctgggattacaggcacacaccaccacacctggctaatttttgtttttttagtagagacagggtttcaccatgttggtcaggctagtcttgaactcatgacctcgtgatctgcccacctcagcctcccaaagtgctgggattacaggcatgagccatcacgcccagctggaacgtgcttttcaaatgtttgtttttgcatttgttctttccatttcttagccctgttttaagggatcagatgaactgctcacacagaaactagagtcgccttccagactgaatgcagaaatactaaagaatcattccagcaaacaaaccaaccccgaagccatgccctacacaccctgacagagccaaagatggggtccagtgcatgattgtcagctgctgcccagtaaatagttctgcgtattgaaaaactcagtattcagcttctgcctttcaaaaaaaaatcatgcttttagaggaatagctgagaatgagctccttcttaatctgtctccactactcacactgcaagaccttccctgtggtccctctcaccttgccagggtcctcagaggcagccttgcacactcagtagtcacatctgcacccttgctgatgtcatgagcccctcatctgtctagtcctcccactgctcctggtgcagactgtcttccgtggtcacaccatggtggctgacaccagccacagcggcagctcctttccagaaacccagatgggacattagagtgcctgccacaccactgcttccacgtgaaaggttgccttggagagacccagaccttttgtttctaagtcttgattaagttttgcttctctcttttattgtaaacaatctacacatagtcccaatgccaagtgtatgtgctccaacatgctgaattggctgcctgaatgaacctgagaaaacagagctagtgtcctatggaccatttataatccacccatcccctgccactgagtgagcccattgtgaggtggcttaggcccttggtacatctgagacaagaaatgagtcaaggactcccagaatttggaaggtgaacgaggaaagataaatcatctagtctctcttccctctttgtagctgagaaggctatgggctcagagagattaaacagtgcatgtgagatcaaaggtgcagtgacaggccacatcaggatgggtcctgctaccttctggctgcttatattctacagcccaagctctctgctcaggcttctaaaaccacatacttatggccacaaggtcacatgacctgaatcacccccagaccaggagcatagccttgtctctagtgaatataatcagggatgaacctaaggcatgaaaacgggcagtgtcttcggggtatccttaatctgtattaaaccagccataatgaaggatttcttcggtggacaaggtacagctttccaagataggagcgaggatgaagaggacactagccccactactcccagatcacagctcagagtagtcaaacaaagaaaaagctctttttatatttatgaaatcgaagtaggaatagaagcaaagtcgtcagaaacaaagaaggaagaaatcctcctgaatgggggaatatagagactgtcatctttaaagaggttcaagtagagcgttcaatgaaacaggaataaacaatccaggagaatcaaagcccacggtgtgttcaggcctagaaggaatgtattaaatgaatctatgctcttttcttgctgttgtatcagatattctaggtacagtgtaggaaatggaattaaatgaagaatcaataaaacaataaacttaagttaatgcaatgttcaagtaaacagattcttctaatctttttcaaaaacgataactgaacattttattatttgggaaatacagtgaaattaaaggtttcttcttattacattgagcccataaggggaatcaggatgttccacaaatatatcacatctcttcaatttttatagtgcacttttaaagaaacaagatcttttttatattattttaacccacgtgtctcgattgccaagtttcagctgaaagaagtttgtcataaatgaattagggaaacatctttaggaatgtcttactgaaacacagaccactcttaactccagaaacactactcactgccaccttcaggtaactgaagaagttggctttgttacccacagattttcatcatatctgaactcagaggagatggaattttatggctatataaaaggacctcatgatataaaatggaaaaaagcaaacattaaactattttatacatttcaataatggttcggctccagtgaccttcttttatatctcccttcaaagggaattgttattatacttttgtcttcttccccttgtttagctccagatcgcctggaggaacgataaaaataaatgaagtccattagataaaattattatttacacaaaggcaatattaattttatctgtcagcaggttttaaaactaagtgaaagttcattcaatctacttctgtgtcagctaaagcaacaaaagtcctttctaagaaaaaaaaaaaaaagaaaaagaaaaaagtacttaaataatgggctttcaaggcaatgtaactaccttggcaatttctaaagaatttacctagagatgtttcctcagggcagaaaattcatgtggacacactaaaatattccagttataggccgcgcgtggtggctcacgcctgtaatccctgcactttgggaggccgaggtgggcggatcatgaggtcagaagatcaagaccatcctggctaacacagtgaaaccccatctctactaaaaatacaaaaaattagccgggcatggtagcgggcacctgcagtcccagctaccctggaggctgaggcaggagaatggcatgaacctgggaggcggagcttgcagtgagctgagatctcgccactgcactccagcctgggtgacacagcgagactccgtctcaaaaaaaaaaagaaagaaagaaagaaaaaaaagaagggagcaccattttctctttcgtccactgcaagatgtggagtctatgccaacacagaaaagcaatgctaccacagtgggaagaaaagacgatacccttctactgtcatcagtctggtcaacatcactgattacttcctgcttgtgaaatccaggaagcttatgtaactagatatctccatggcctttgtgaccactgacctttccttgaatatctcctgacatcctgtcttccctggattctgtaactccccaatctctctgtatttatttcacatctggcattctcctcgaatgaaagtacactccaacctcttctgaatgttcattgttttctccatctacacgttctcagaggcccttttcttcaaacccatgtgatttcacatggtctctaaaaactggtgactctcaaatctagatcctctccccaacctctgtatataatctagactcatacatcaaaataggggtatttacatataaaagccagtgtaactgctctaaagcaggcctcattatctgtcttcatcagctgtctcccttgcgtctgcttcctctcatagctaactacaccatcactcagacagccaactcagagctcaagggatacccaccattccctcctcctccatcttaccaaaactcactcctcattttgtgagtgtcttgacaatccttcccttacccacatttagaacccatgccctcctctggaatccatgccctcctctctgtcctgaccaacctcctgtatttcttacctctgcaatttcagccatttttgttgttgttgttgagtttccttgctgctaatcccaacccttaagcatcacttctatggagccttctatgaattttttcccacttttctctcgtccctatctggccccactgtacgttgattcttattcctgttacagcctttatcatcctgaactacaattacctgtgtatctgcctccttctaaaacaaggctgttaaaaactcagtctccagatagtactggacatagtgcagaaaaacaatcaacacctgagaagtggattgatggagaaaaagaatgcaaatccacatgtgcctctctaccttacctctgtacctctttacaatattagcacttccattaaaatgccatccaagttcccttttcttctatgactctgccattcgttgtcacagatgttttatccctcttttaaaattctcttaacatctggtccaaatataaagattcccatggttttgaaaaatgtcctttctaaatgtcataattgtccaattaatggtcaaagggatgaagggattactatagccagacagacttaaaaaaaggggggtcccctgggcctggaaacatgaaagcagacggaagatatcaccaaatgtatgaaccctgagggggtcagataagttattccagcacagataattcactggaaccacttgaaatgtcaaaggacaaaaaaggaggatattataattcacaccagaaagaaacttactgaattaataattttaggttaagaaatacaaataccttaaaatattatcagataaatttacagtaaatagactgctaataaacttagataaactatttagcagaaaggcttctgatctgatgttttcagattttagtcaggaataacacggtgtatatctgatgaaaccttttaaatccaatggattagacatgtcaatgccgatacctttgagttaattagagtttgtcacaatctttgatctcaaaaaaaaaaagtcagacctctagagcactaatcaccatttttggtgagtatattaaaaataaaaataagaaatccatcctaaaagaaaaaattaccaagacatatcatataaaaatcaaagatttcactaactagacaataaaaaagatgcaaaaaatccaaagtaggttatgtacactactcaaacatcttttacaggtttcctgaaatagacctataagataagtgttctcattcctttgccattttgcagatgtggagacaggactcaaggaggtcccatttccaaatggaagaagtaaaattttaacaggtaagtccctggccctaaaacccagggtcatcttgctgtcctctcacttctacaaagattgtctattgactaaggattaggagtcatgctagacacacaggtcatccagctgaagaaataagctgatgatttattcctactaactaacttcttgtcgggcctgaaaatgtgttttcttagagaggaaaatttcactaagtaactagctgcagcatcattcactgaccctgggaccagagacctcactgaccaggatttaatccagcaaatgacgcaatggctttgtccgtgtcatgtgccctcctgtccttgaggcaggggcagaggggcaggatgggctcattcagtcccatgacttaaataacatttatcggctggtgaatataagtgtacatatcaccttcaacctgtgcctgaaactgcaacttcatctgcctcttcatctctacctgagacaaagaattgcctcccaactaaccaggatcaagcaaaccactggtggtcccccttccccagtctacttcctggctgagtcttcgccatcacagctggagtcattttggattgctctaattcccccacacaacactctaaaccataagcaaatcccgtcactacttcctcaaaaaatgtataccgcacccctgtccccttctctcccatctgctactgcaatcccacctcaagcaccttcctctctcacctggatttagcagaagctattctaatgtgccttggtgtttttcattcatgcccctcaaaagtccattttctgtgttgcatccagataaatctttgtaaagagctcatctgattaagtaatttttccctgttcaaaaatttccaatagatctctttgcaacctccctaaaatgcaagatcctgaccccaccaacaaaccctcctccatggccacctccctatttctacatgatctccagccttcctgttccctgtgctcccgccacacacatgcacacacacatatgcacatgcacgcgtgtgcatggaactgctttctggtcttgaaacccaccaagctcatcaccttgcagatggcgcttgctggcccttagatcctagatctttttctacattctcccaaggtcccttctcactattcaggttttactaaaatgtcacctctacaggaaagcctccctggccaggcaggctaaagtacctcccttttactccactattagattccattattattttatcttcttcacatcacttaaaactacttaaaattgcttgactgatacatttttgagtttgggaatttttttacatcctattatatgaaattgatttaaaggatctataattttcacagcttctccttttaatgtgctgtatgtatatcaaaataacatgttgtacatcttaggtatatacaagtaaatacataaataaataaaaatatttcataagatacaggtatattcagtaccttcaaagaaggtaaattgagggggggaagcttcagtaatgggacagaataaaatatattggcgagctcaatgacagcaaaatagtttccagaggcctttgtcctcagtcatttcagtgatattggatatgtatgcttgtgtgggaggaataacaggacttagattatgatagtcagttgatgtccttgtgtgagtcctgtttaacacactggaatacaagtaactggaggacagattttattttgttctcttgctatccccagggcctaggacacagtatgacccatataaatattatcaactgattgactaggcagtggaaaggccagaaaccaagatagtcattttccaagtgatggataaactcactatgaaggccaagataccttctactaaataaaggcaatgaatcatccactttattttagccattgagcagtgcttacggcaagtttcaggagcactgctatggaaaagtacaagttagttcacagtcagcctattaggtgaaacttaggaatacaaagtcagtacagaattagcttcccctaaagcatctaatgattagcacatatgcgatgctataaaatctcacatgctgtgaacatacggtatctcatccttcagttcattagcctgaaatgtggagaggtcatggaggacattacaataaaggtctccatggtggaaaagtaacccccaagtgtgttcacttctgtatttcaaaatattaaaacctatgtgatgggaaatatgttaatgaaaatacaaaaatgatcccatcctaaatataaagccagaaaagtgaatgacagattgcatccatttggtaagtagctcctaaatactgaaggggttaaatactgttgctggatgcctgactgtctcctttttcagtccaaaagagtgagaaccatctacggtgttcctcagcctacaaagtaccagtgatccaccctgcctccaatgctagtttaggagaggcagccttgcatagatactaggagcacagactctggatccagatcacctgggttcaaatcttcgctccaccattaaccttatgcttcagttcccatgccctgtaatatggagataaaaaccatagcttaaaattatatgagttaatttgaaagaacttagaccacttactggcaattacgaagcactaaaaaattttgacaattataaacaaataaaggctatttaataaaaagaaaaatgctttataaatcttgtaggaaagacacgtctaacaaacaaattagtgtcttcctaaaaaaagacaataaaaccagttcagtgtttaataagaacagtgagaatgtgctgccttagccttaggaaaattcaacatctgcccaagaaatctataaaagaatgctcatagcagcattgttcataatagcaaaaaattagaaataatacaggtgtccattgagagaatgcaaatattcatggtctcttatatcacagtgaaaatggatggacaacagctatatgcaaagtaaatattagaaataagaacgttgagagaaaaaagaataatatagtaaatcaatatttaccgccaataaaaaaacaagcacaattaaacaatattttgaattcgataaaagtaaatgtgcaaggaaaagtaaaaggaagcttcacagtagtgctactgtgaatatgaataagtgtggtatgaacaacagaggtattccccaggatcaagcccccagtggaatgaggtcacccacagtccttcttaggccccacactttcccacttccacccttctgcctggaacacactcccccatgtccattttagaaccttatccattctctgaggtccaaatcaaacaccagctcccccaagagtggtaaccatttaccatgtgagaagcaaggaagcctccaggaagcgtgctcaggacacaccattgcctccatggccctcagcacgccctgccgtggagtctggcttcctgtgatgtgggatacggtgtccctgctgtacactaaagccacaagaccagagcctggcctgcttgttactgtggccactcactgcccaccaaagtttcttgcacgtagaaagtacctaatatttatggaatgaacataacaaccaaccgagcaataacaagtcatggaaagaagccccaggttgatctgggaggaggtgggggagcaggcaggttttggaagtgtgggaatcatgtcaacgaagtggaaataaagagaccacacttttggcagagaaatgaaataaagtctcaagatagaatgtaccaagaatggaggtagcaaatgcatttttgtttgaaaagaccaaagttataagtagtatggcacatccatactattaaatattatacagcttattaagccaatgtagtaaaactctatatactgagtttataaattcaataatgatgtgagtggaaaaaaataaagtgcagacatttatttatctatagattaaaaatagagaagaaaaactccaatgtttgactaaaataaactaatttttttaatgtttgtaagtgccaagaaaattgtggttactcctaagtcgtaggaaaatttttaaaaatataattctatattaaattttcaacaatatgcatttattaatttggtaatttaaaatgagcaaaatatttacatttaaaggaaggaggtaagattagttttatgggttaaccagtgagacaggacttcaatgcacatatttagatccagttcagggttgacttgccaggtataagacagcagaaaaccatggagggaaccattgctgcagtacggaaaagaaaaaactggttcaaagaatgggaggtgtgaagatataaaccttcataaagcagaggtcttctttccataagtgttctccaaactgaacgtgaaatctttgttattctcatgtaaagttgggccaaaaaaaagttatgttcagaatgtgtggcgtacaggtgtagcctgtaagtcaatgatagccattcctaaaactggaacctgctacctcttacttgctagactcagtttacctggagggaaaaaagtcacttgtacctaaggaaatgaaattggttttatcagctgcatcagataaactatgttatccaaagctttctgcttataccaagaagaaatgctcaggcacatagtcattgacactttccactgtgacttggccatactgcattttggtcctcaaagtggcccccgtagctaggtaaatagaacacacctgttaattcgttataggcaaagtagcacacatgtttttctctgtatgcaatagattacatttctggttgagtgagtagatgaaagtgatgtgccttctctaacatcatatgtaggaggaaaaatgttctgcttaatcttactgttcaagaaaatccctgcagttctctttgattatgaccacagtaacataagagacagttcattaaccacagagatgaaactggaggagatggggctgtgctttaaggaataaacacttcattctggaaggtcagatgtttcccaagcacaaatctcacagtttaaggatacttccttgcaggggcacacagacagatctatttagtttagtaactaataccgtgtatcacaataaatgacaggttgtggaaggaagctacccacacgagaagtctggaaaaaagttagtttacaacttgtaggatcaggcagtactttaatgactgtgagttttaaaacacaaacatgaggcagttggttggtatggctgcttaacagaacggtctcttttgatttaatgcgcgtgcgtgcacacacacacacacacacacacacacacacaaatacatcctaagagcttaacattatttatctactttgcctagttggtttcacctctaggacattctccaaaggaattcatcagatattttgtgctgggtatattttcttgatttctgtattcttgatcctctggcatttggagccttgtttctagagagactggccctcctagggctagcatattcgtaaagacagcaaacaacaccccagaggatacctctgcatacctaccaaccagccaagccagagcccccactctcaaccatctcctttatcaaattctcacccaatgtgctaatgttccccctacctaaagcaccccagagccaactaccacagcagtagggaacaccacatagcccagcacccaccaaaaatactcaaactctcaaatcctaaacttagtgtactcaccctgccttgcccactccttacagagagaaccccagtcaagcctctgcaagcctcggttttcttctgcctcccaaccctccctggtccttccccacgtggccctgtgtagcattatgagcctcctgtttacagagtctgtgagcataaaccttttcttcatgaccatcatgtctgcctctgctgtctcaccatccttgattaacacaaatcccacagacatttttaacatagatgtcagcaaagatttacactgaaatatattcaacctagtctgattattatgtgttacaagcatcgtttggaagcttctactgaggaagagggaaatagttctatacaaatggaacaaggaagacaaaaaaaaaaaataggaccaaagaagacaaaataaaatcaggaagacaagacattgcttttaagataaatatgctcaagttataatattaagtgtattggcaagaaactcaactctatgtacagcacataaacaaacacacacatagttgcacacccacatatacacatccacacagctgcacacataaatgagtgctcatgtgaatgcacacacaaaaacactttcatattgaaatataaacatacatttctataatttataaaaccagctgcacctatcagtgccaggttgcaaattccagctcagccacttcctggttgtgtgttctgtgcttccatcttcaagtggggataatactagcacctttctcatatggtttgtaaggatttaataatttaatcaacgtaaaacacttagaacagtgccaggtccactgcaagtactcaataatggttagacatgacaatgcaggtctttaaggttataatgaacatctggagaaaaacacacccaatcattagaacattctgagatatatggctttgcacatttttaatgctttggggcaattgtttttgcaagattaatgtaaattagcatgtatgattattataataaaaagtcatgtatccttttgctaagaagatgctgcagacaagaatcaagatgaattgggagcttaagcgctgtctctaattcacaccaccagaggattgcagtagctttactaataagtccagtccccataaatttgttatacatggtcatgcttgaagatggcatcaagaatgtggaagacagtgtcaaagacagcccttaattatttttaaaatgactagaattctcataccaaattctcaaatcaccatccaaacagcctcatcctaactccacaacaccatgttgatcacgattccctggagcttggcatgtgagtggtgctcttctgataggaagagctgatccacgctatcatcttcagagaaaaataaaatagagtgcaatgatatgcccaacttctctacaggaaatccaacatggccaagtattttttttccacagtagaaaacttgaatttaaattagattttttacataagcagcacaatgaccaaagaccactgactgagatgaaaacagaaaaacacacgtcaaggaaaacactatgatatccagaagcctagaaaaaatatgacactggtgtggcatcaaattccagatcaaattaagtgcactggtggcaagcatccataacttcctaaatggaagtcggagctaaagtgttcaaaaacaccagagctggcatcttcatttatcttgagagtttcccccacatatcgtactgaagataaaatacaatgagatcataacccttcaaaagcgtagcttattgtgcaatatttttctccagtggttaatggtgattctcacagattggaacagaaaaggttatagcaagggccaggtctgcaaacacattgagaaaataatttcctaacagacaagagcctcagtagagtagaaaagacaccagcatggctgaggatactgaagaactgcaattcaggtagatcaggtaccaagcccttctgcccttcagatgaaaagtctcttccatttaccaaatttgcccacaaaaatatttcaattttctgtgtctaatgtcatgaaaaactttggaaaaaactatgagagtttgagaaacacaggcctaggtttaatctggaaaataaagtatgattcggcaaagtgaaccttctagcaccaggttatcagcaatctagaaagtggctgtgccaggacttgaattcacatgtgtctgaatcggaaaccactgtgcaagcctgtgctaccaatggtataaagactgactgttttgagtatcctgataatttgcaaaaatattgtaccatcatcatcaaagaaaacgccacattttttaactttgaaaaatgtgtgcttcatttcaaatgtaagatagtgctaagatagttacctctctataaaaaatgaatttcaataacccagcaatcccactcctatgtctatatctaagagaaagaaaatatctgttcacataaaacttgtacatgaacattcatagcagcactattgataatagtctaaaaagtagaaatgatctgaatgtccatcaactaatacatggagaacagatgaagaaaatgtggtagatgctacaatgaagtgttattcagccagtaaaaggaataaagtgctgacatatgctataatgtggatgctataacatgctataagccttgaaaacatgataagtgaaagaaatcaggcacaataggccacacattttacgattccatgtatataaaatatctagaatatgcaaatccgtagagacagaatatagattagtgattgccaggggttgatggaaggaagaatggagagtttctgctaatggatacgggtgttctttctggggtcatcagaatgttctaaatttagataacagtggtggttacacagctctgtgaatgtatgaaaaattatgaaaaatctcaaaagggtaaattttatgatatgtgatttatatcttatgtaaagctgttattaaaaaataatttccaactagcaaccaggctaccaggttcttgtgatgatggttccagcagaagctggtgatagagaaagaagattagggtgtggctgatgacggaaaggggccttgaggggaacttctcagtcttgggtaagaggggcttccacagtggtgtttggtgatagcggtgactatgggagtcacaaaagtaaaggagagagctctttatataggaagctttccatagtctaggttcccattagcttgacatagatggtgaagggggataagatactggtatacatacaaagtaaaagagccatatacaccgtggaatactatgcagccataaaaaaggatgacttcatatcctttgcaggaacatctatgaagctgtgaaccatcattctcagcaaactaacacaggaacagaaaaccaaacaccacatgttctcactcataagtgggagttgaacaatgagaacacatggacacagcgaggggaacatcacacaccagggcctgtcgcagggttggaggcgaagtgagggagagcattaagacaaatacctaatgcatgtagggcttaaaacctagatgatgggttgataggtgcagcaaaccaccacagcatatgtatacctatgtaacaagcctgcacgttctgcacatgtatcccagaacttaaagtaaaatttaaaaaataaaagaattaaactcagataacttaaaaaataaaaattaaaaataaattctttttatcattttcaattcagaataatttgatcaatttagacaaattaaacaatctgaagatctaaaaaaaaatgtaaaattgacattcttcttcaatagtttgaacacaatgtacatttttttttttttttttttttttgagacggagtctcgctctgtcgcccaggctggagtgcagtggcgggatctcggctcactgcaagctccgcctcccgggttcacgccattctcccgcctcagcctcccaagtagctgggactacaggcgcccgccactacgcccggctaattttttgtatttttagtagagacggggtttcaccattttagccgggatggtctcgatctcctgacctcgtgatccgcccgcctcggcctcccaaaacattttttactgaaatgcaccagctctccagatagctcattgccctgttaatattcatgaagaaatcaactctacaattactttaaatacgttacattatatacaattataatttattataatttacattacctagaattataaattacttcatgatttatatgacttatttccatgatttatttaatgcttgtgttggtggagaccagtgtctgacctcaggaactcactctcctctccaaaatgcatgcttttgtgtacccttagacaaccctgagagactaggtacacatttcttcactccaacttgtttattaaaaatttccattcttttcccagaattttttttccactgttcaagcaattaaggcaaatagctaaagaaaactttttcagtactggtcattcccaaagagaagagcaagctggaagacccagtgagcatgaaggtggatgagcagtatccataaaagtcgcgccacactgcctggacctatttcttccactatgtatcacaagtgcttgcatattttactgtacagtgtgttaagtttcagtgaagacaaagggtctagtgccatatgtcagccaaagacaatgtttcccatggtgtccacccttaattattaaacatgtccttctagaatctcagaactatcccaaaggccatatgtgccacctcgtaatgtgaggcctcaatcttatgacacctgtgcaattacaatgactcagcatccccgtgtggtcctcttctcagctcctaaaagaatcaccctcattccaccattgccaaagcacaggaatataatgtgggacgtgctgtcaaaacaggatttcagatcacaaaatagttatgttccccaaaatcacagttctataaatcgttagcaagcatctttccataaattaatgccttgaccactaggcaagactctcatcctatggggattttctgggcaatgtttttgtcctataggagttttccttaaaaaatttaaagatgagaatcagcctggggttgctagttaagctcaacacagtcctaataagcagctgcttctgctcccaactgtcaccattccctccatatcaatatctctgagaaggtcagcacactgtcttcagcatgctctaataaatcaaacacaagtttgtaccagtcgaataaggccccgtgtatgtgttgctacacacttgtctccactggtctacaacatagaaaattgtgtccttatttgctgtaaccacatgttcactacaattaactctatacatgtacacactacatgctggactcagatgtctaaaccatacttctttggcccatctatctctcttaatgtcaatctataaaggaggatccacagaacattcatgtaattactacaattaacaaggagatgcaagtcacggccagggactagtaagttctgctataaacacacaatcacagagcaataaaggattttggcagcttatctgctctttcatcacctctctggctcttgcaaaagtggagtgtctcaacctcaccaccaatttcacaagagatgctatgactttatctatgattcctccatgcaaatgtgactattctataggccctttgagctctttctggaatcacacagatgtgagtttgaaatatgccccactttccagctttgtgactttgaaagagttactaatcttcggtaattctcttttttcttcttctaagaagtaccatctacctgtcaaggttttggggttttgagtgttagtgaggtgaaatgatctactggtaccatctacctgtcaaggttttggggttttgaatgttagtgaggtgaaatgatctactggtaccatctactcatcaaggttttggggttttgaatgttagtgaggtgaaataatctactggtaccgtctacttgtcaagggtttgaagacccaataatctcatcctgcttttaatgttcccaatacaccatcagaactgtattaagggtccacaagatgttatctgttgaatgcccttctcaccttgccccagccagtatcctggttgaatcattcctggctctgttctcctttttctctcatgtatcctcaacatggcttaaacccatctatcaggaacttctggacttggtcttatgacagcccctgaacatggccagcaagatgcaacacaaactcactccaaattcctcttcctgcctcatggtcctctttgcaccaacaattcagcacccttgacaccagcattttcatgcctacatgccccttgctctttatgctccaaatgccatctccaaactacaattttctatcttctcccattttatgaagatccactacaaatgcatccacaaaagctgtgttaattaccctctgtcatggcccattcgaatgaattattccttccaatttgcattcaaactcattgtatataccccttattatttcacttacaaagtgatataactgtttatgaatttaactccccaatacaaaccagaccgtaagcaaagacactcttttagtacagtacacatttttatcacaatcgagcttaggtctgaaacattgcagagacacaggcaatgtttgtaagacaaatgaggaagcacaaggaaagattaggaagcccagctcctccactaggcacccgagtttaagtctctgtactgccccttgctggctgggtgactttgggcgagttatttcacctcactaacattcagctgctcgttacaacactagcatattaattgtactttccttgtgggttgctataaggattgtaatattgaataccctccatgcatcatctcacactgactagcatacaatgattaacacatacctgctgccacattataatgaaaattggaacccccaattttaagccatctcatgctctgctgaaaaatgagccaatcctctttgctgaatgctccttgacagtccacagaggcttaaggcttagaagcaaagaacttattaaaataggagggaacgagagaaaagggaaacagtaactgttcacagacagctctcctcttctgccactacagccagtcagaaacatggcaaaggtctggatatagagtgtttacatccaagttctaagcctcacccagcctcctactgtgaatcagtttgtttgtttgtttgtctgtttgtttgttttttgagatgaagtctcgctctgttgcccaggctggagtacagtggcatgatcttggctcactgcaaactctgcctccccagttcaagcaattctcccgcctcagtctccccagtagcggggattacagatgcatgccaccatgccaggctaattttgtatttttagtagagatgcggtttcaccatgttggctaggctggtcttgaactcctgacctcaggtgatctgcctacctcagcctctcaaagtgctgggattacaggcgtgagccaccatgcctggcctgtgaataggttttaaaagaattacatatgatttctctgttcattttcccacctatgaaatctacagctgtcatatttcccagaaccatggtgatacgcgttttcattagctgcctgccatgaagttagattaagaagacatcaatgattttttctaatcaaagtcataaagtcaagtggtttcaaataacaacctccactatatatatgttaaagagaaaaatagcacccatatcgcagcctgggtgcccataatcttctaataccagtaataaatctttctgcgaaggctaaatcatttataaacttgttaacacagctcaagtctctaatgctgtatcactaggtttcttacttaatcaaattgtttaaaaatgtgtatttgcaatactgagtgattaggaggtttatcttatgaaagaccattccagtgtcccgttgtacacaaataatttgaaggcaatttccccttgttaagggtaaaaactctgattagactaacttctgatagctagttattgagatcacagaaagaatgcagccactagtgaataaacaaatactaagaccttccaggtggactgtctcaggtgacctccaaaggttaattcatgtaaaaaggatactgccattacaaccagaaaccaacaagttatgccctccttttgaaaagtattagattccaggatggattatccagccaaccaaagaaagggcgaatataaggtaaccagctctccagagtatgttctctcacccagtttaatgggaagctatgtggtttggaagcaaattctagagttacagaatgttaagcaagatattcattattttaccccatcatgaaacaacaagcccaaacagctaactccaggaacgttttctgagaccgtgtgcacatcaagaaacaagaaacaaaataggttgttgaaaacacccacatgttacagcatttctgcccttcctgaggatgggaataacattagaaataacttcacagaaaaacagactccccagagattcaaaattccccaggaatctcaccatttggacagacatatgtactctggaaaaattgttcctatcatccagtagccatgaattctaacttagtctaaactttccattcaaaaggcagcacctttcttaattttaagcaatgtctaaagtccaaagccccaggacaacatttcttctgagcctgtgtcagcttcattcagtctcattgaactgaatgatgtataatcaaagccaatgggattctgaaggagagagaaagtgagaatactagactcaaacctgaacagagctgagtcaattacagaaaagtcttggcaaagtaacttcagccccatgaggtgctgtttctctgtgggtaaataaggatactcacagccccctgtctcttggggcatttgcaaggagtgaatgagctaatacgtacaaaaggtggccagaatgctgggtgcacagctaatggccaataatcatgaattaatctccatgcccttttaaatggagggacttcgaatatgctggattctcttccatatcacttattactccatcattgaattggccatatagaaggcatatgcaggtaaacgatgtctgtaacagaggtcaccaactcatccacggtgagcagatgcagacaggtgcatcatataaggtcacaagtggccagcaaagaaaaggactcacaggccagcagaaacaacaagatgatgaatatctgggacctgtctttacccaacaggaataaaagaaacttgggtttccaatttaccatgaatgatgatggtactacaggtcttctgccttacgtagtcagagaagtagacatggaggaagaatttgttagaagcaaaataaagcgaacatggttaaaatgacaacaacaaactagctctgtctcagaggactccgcatgcacaagagcagtatttgtccaaacacaaacattttcccagtggcaatgacttacttactgctaagtccagcagaggcagcgatactaatttataatgtgtgaaataaagaaaagataacacaggcttctaaaaggctggccagtgggaatagtcacataaagatcccagcctagatttattaaaaattacaataattagtcctagaaaagtagaaaactagaattattttctcaaacataaaacaaactgccctcatgtcagtactcaattccagtgagaattgaataaatttctgctttgggaaaaaaccagcaacactgattttatctttaataaaaggagttataaatatcaagaaaatattttgatttgtataaatgcatcaaatataaaatttaagccttaaatatttattggatatgtcaagtatggatggcactggacattttaaaaattattcaaagaaattttaacaggtattaagtaactcaaatccaaattagaaaagaagaaacatatataggttaatgtataataactgataaaatatcagatttaaaatcataaaacatctgtaagtttaacacaaatgtgaaatgtttacgtgaagagaatgtacggaaatgatattaaatgaaattagcccaatgcaagtaggtgtcctgtagtagatagatttcaaacaggtctttcagtaaaagttagacagttattaccatggaatttggaaaatggaaaattaagagattctagaatgaggaaggtactgtatcaaatttctcagagaataaacactattccagagttccttagcttcagcgtgactgtcattttggacaggatacatgtttattgtggatctgtcctgtgcattgaaggatgcttagcggtattgcctgctgcttttcatgagatgtctgtagcacaagaaacagtcttgacaatcttagtgatgtttctaaatattgacaaatgtccccttgcagaggaggagaaggcagaattgctctcccttccattgaggaccactgctgtatacaaagatacaatctacaaaaagagtatgtaacaagtagactaaacataaagagagaatatcgtgattttattttccatattttgattttcttctctacttactgtgctaatacgatcttacagaaagtgctacgcatagtaatcaaaactgtatcctgaattagtacaacacaatttcagcacaatgaaacatgggtttcaaaaatcagttatataatggataccagaaaaacaggcttctgttaccacagtaataaggacagcacagtttggtaaatgaagtgaacattgaaatttagccctcatttaacacatttctaaaacttaagcaggaaccacaaacctccaagggaagtgtattttggtcccataagctacctggctgcatttgctttgctttgctaatgacaacagaattaccagccaagtgttcacctgtggaagaggggctataccttcacagggatcagcaataaagaataaaatcttcctcagtccccagctaccctccccatctcttaccctcatgctgctaggtcaactaagccattccttatcagttgatgcagtggcctgccagattcctttaagctctggatggtgagtacctagcgcaaaagtcactttaggaaaaagaagagtctgtagtcctgccttaccaccatcaccatcaccatcatcaccatctctaccaccatcaccaccaataccactaccatgaccaccatcatcattgtcaacaccaccactatgacttttaccactattgccaccatcactactactgccatcatcaccatcactaccaacaccacaactaccaccatcattaccatcactatgaccatcaccactaccaccacaccacaccacaatcactaccacaatcatcaccaacactaccatcaccaccaccattttcaccaccatcttcaacatcattatcaccaccaccaccaccacaatcaccaacaccactgttaccaccaccaccatcaccaccaccaccactacagctagctagaagtctcactctccacagcacggaatactataaccctgcattgggctccagcacaatcaaacttctccttgaacataatccactaaggcactccagctcacacttcttaactccactagacttttctacttcctgcacttttacaattccagaactttctgaagtcattatcttgatctgggatgtcctctccacacaaattcttaggttaccaacttattaagtcaaacttgaagcacagtggatatgcagtaaatactgaattgctcacaaattacagaaattccctccatgatatgaaacaagctttccagtggattggcatctattgatttaactcctacatcgtgcttagtaggtgcaggcatggtactaagtattttatattatcagttgatttatcctcataacagcacaacacaacggttactattattatcctcatttttcatatgaagaaactgaggcaaagggacatcaagaaaggtgcacaagttcacagaactaaaatttgaatccaggcagcagtctcaccatgatctctgaaccactccaatgtgtagctactctacactgaaaacaatttcaaaacaaatttttagttattttttttttaaatgtcatagagtctaagagatagccagagatttttctaacaacagaatcctatttttaagagcctcaagcccagcctccctctcctctgagagcacgttgaagaaaatttgggcccattttaaacacagtttagacatcactgtttttacggcaaatatttgtttttcacagacatggaaactaagacctgagaaagggtagtcgtttacccaagtaacactgaattagttggcagcagagttgaaactaaaaccctggagtcccgatgccaactggatgattttcaattatcccttggccccctggctaatcattaaatagattttctacagaaaggtgcagtttcatatctaccaggtaagaaacatggttgatgacacatgaaaatgattcactagaaaagacaaaagataatcattcacccaaacacgcctcttgctaaatcttcagagtctaatatcgcacagtgcaatttgggattcaggctttacctctcatctaaggagtccaaagcccttctcaggcaaccctgggccactaagttactggccagttagcaacagagaaaccatgtaacaaaaattgtactcatctggtaggctgagttcatggccaagccagaaccaaaactccacctctctctgtacatccacctgtgatctggtgcatgcccccagccctgggctccccctcccgacccacacctgtgaggggacctttacctgcgtgtgctggaggctcctcagctgtttctccttctctgtaactgatttactggctgaccttcagaccatcttaagcctttccatgactaagtttctcctgtgcaaaattacacttctctctctgaggaggtgttgagaatgattaaatgaacctggccacagagcgagagctcgtcagacacgaggcattagatcggggggctgtgttgtccgcggggtgctttctggtgatcattcatgcagatacccaaatcaaagtctccaggtaaagaaaacgactttggaaaactctgtggttttaacaaacacataacaatgcccccacccccaccgttctctggtttcatattaagtaaatcttttactgagggttttttctatccaggcacaatggaaccctgataaaaaattttatgtatcttctatgaaaatacctataaaaataatttgatgggaaaaaatctcttttagcttctgttttaccatgagaatttctttttttagagacaattaaaagttaacacaaaagttttatttctcagtacctgtaatttgtttttattaaattaaagaaagagtatacataacagataagcattcacctatacctataataactgggaaaaaaatcatatgatcatgtaggtctattaagaaagtaaaaattaaatataacaatgcactccagaaatggatactaagatcttatttaaaatacagtatgtatgactaataaattgtcattctcattaccatgctccaaatagttatttcctttcttaattcaccttttgaaagcattttgttccattttcctggggctgttttactgcgtgacttccctgggcattcaacagtcaatctccgcaggattgggattttcatttcacgtgtctttaatctagcaaagcattcaggctactcttttcacagatataaataagtaaatacaacaatcttcaggtaaagaaaaaatacattcctcagggacaaggataaagctggaagccatcttcctcagcaaacaaacacaggaacagaaaaccaaacactgcatgttctcacttataagtggtagttgaacattgagaacacgtggacacagagaggcgagcatcacacacctgggccttttaggaggtgggggtgaggggaggaatcttagagagcgggtcaataggtgcagcaaaacaccatggcccacgtatatctgtgcaacaaacctgcacattctgaatatgtaccccactttttttagaagaaatgaaaaacaaaaaaaaattttaaagaataaaagcaggaaaaaaaaaaaagacattcaagccgcctacatttccataacagagcgttctctatctacttactatatttattcttgagttatagcaaatgacaatttccatctggacttttttttttttttaaataaaggcatttctcatttcatcttgtgataatttgaaaaactatgtatactgtgtaacctaaataaaatagattatagcaccactccaaaaattgctgtcaacttccacacatactaagctagtggacctaccccaggcaaaagaaacagggtcagatgctgcctaatagaaatcaagtgacacgtctttagcatgttctttgctatgccactggttatctgtagaggctccagagtttagtaagtcttcttaattggacatcatttagctcagccactgggctcaagtagacaaataggaagtgagttttccatgtgtactctgttccttatctgcacagtgggtgccctctgaactgagcctcatcagaggctatgtgtctcagcccacacgcaagcaacgtgcatgctgcctgaagtggaagcaaaagtgtgttgttagttgcgcacccatagaagcacacctgagcctccctatacagtgcccaactagaagaggctgagcacttccctcctgtcatttgtagactgatagtccagtcccatcattaccaggtctcacccactgccagaaggatggctcgtcctcagtcccatgaactcagctgtgctcatgagttaccaatgaggaagggatgaaaggagaaaataaaaattaatcttggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaattaatcttgtatccacaaaacataaaaactcacattaagtatcccatcatgattataaaatatcaccactcatcacctataggaggataaactaaggctagttaagggtaaatgatattgtgactgtcaggactagggcatttgtttagaatgacatagaaggtcttagctaaatccatgcaaagtgttccccgaaatgaacgttcagtctcctccaggaaggtgattccccgtctcagtaaaacataggtagaaaaatcagtcttatcatgggttacagaataccctttcctttctacctcccccttctgcttgtcctaattaagtcctcgaaaattaattgtataaaaacaaaatgtagtctaccacttattagattatcctatacccaatagactatgcatgaagatctttggaatgatttccttgattgacctacaatattctttaaactctcagatcaggactgtatataaagtaaattataaactgttttattgttattcctctactacttcattgctttttttttttttttttcacatggaacagtcccccttgttattacaggctaagaatctcttatctgaaatgcttggggccagaacggattcagattttgcattttttttttttttttttggattttgggatattggcatatacataacaagttatcgtggggatagaacccaagtctaatcttgaaatctctttatgtttaaatacaccttatacgcatagcctgaaggtgatttatacaatatgtttaataattttatgcatgaaacaatgttttgacagcattttgactacaatccatcaaatgagatcaggtgtagaattttccacctgtggtatcatcttggcactcgaaaatgttttagattttggatcactttggactttagttttttagattagagatgctcatcctgcattttcttgtataaagatacttcattaccatggcaaagcattcctgtaccatccattaacaatctctggtgtttcgttcataatgtgtaccattccatatttcccatccagtgaaatgtatgcataacaagtattggcaggagacaaaacaaaatccttactcctagctatgggtacaaagtcaggtggccaggcattgggctcctagcagtcaagagtgaaggagacattggggaaggtgggcaggtcctcaggaaaactggaaataaaattatccagtgacaggacagtggccaaaaacatttctcaaattgtcatgggaatggtttacaggagaatgggcgttacttaaacacaggccacttatgacagcaaacgtaaccatctacactagatatatatggcattaatcagaaataaagatgttagaaggagaagaatcagaaataacacacctggattctgagcctttggaaagattttgaaagtttaggcaaagagcatccaaggcttcaatggcatgtacagagtattgagcaagatggagctaggagtcacataaacgggctgttatacactggcatattgggcaaagccttctggtatattccagcaagacttcataacgaaagaccttacgccttaaaatagtattaattgaaaagaatgataaggcctgctgggggctaaaagggcgtagaagaagacagatttagaagagagggtaagaatgaatgcttgaaatcattgcataaattaataagtttctgtgtatgtttaccctgttgagtatccacagttacaggatagggaagacaagtggtagcagatattatgtgacaatgtttttgttatacatagacaacaaaagctccatatgctcaacaaaagtcagattacagagccataataatgtacatgtttctgaaacattcctgtattttgagtttccctcaaagcctagcatttataaagtttatcgctggtcctttcaatgaatttcactgaacacaagccaggcatgtatcaaaataggtatataaaatctctataaagtaaataaaactcatcagagaagctggaacagaacatttcctaactttttttcaatctgggaggatctgattcataattatcatctactgtctttcttgactaacaagtgagagccaaaaggatacccaacccttttgtcttggtgaaatgaaaatctattatgtaattattttacaaataacacatataacatgtataaacagacgttattataatcatcatatttcattttaatatttgaggctttaaaggataccattaaacaacattaatttcatttacaataaatgaagcataagacatggaaaactacttggctgcatttaagatctagcgattcaactataaggaaaaattactttcatcgaagatgacagttttcctctagctcttcctactgatgcctatgcaatacagtctcactaaatgagcataaaataaaaagatgtccatttgatctttggacaaagatcagatttgatgacacagatctacatccagtggtctgattatggatcctgcataaatagatggaaataggttcactttcaaacgtttaggcatcattggcaagactgacgcttctgctttctaccagtcataatatgaaaacattggcaatgacctttactagaaatcttcatgcaaatgcaacaagaaactcacccaaaacattagcagaacctaccagatctattcattagaagaaaatatcaaccataggtatcattcacaagtaagagaagaaaagcattagtcattttacctagtatcacaccatgggcttttgagttggcaaaaatgggaatgaatcccagcttcatgactctaccctgggaaagtgacatatttctgtgtctcagctttatctgttaaatgggaccaagagcccgttaccttgtagggttcacaagatgactgattgaaacaacatatgtaaaacacctaggacagtgcctgcatatagcatgtccgctataaatatcactccctttcataggcgactgctctaaaaatattatgtcatttcatagatgggtctcaattattttgtgattcattgcctcccaaagatcaatctacttgacacaaaggaaagatctagtcaccatgagacagaatggatattgaagcatacagacatttgactcaaattaatcaaaaagttgcatttttcagtaagtcagctattaccaagtgcttcttatgaatagttattttaagatgcagctttccagaaatactgctttcttaaacaaagtttcattccagaaaggaaaaagcctttggccaatttagaagaagctttgtaccattcctgggaactgctcagcatctggggttgctggattttaagatggagttctcctatctaataaagctgctatgatcattgaacacagacacatgtaagatgtgttggggccttggggacgtaaaatgatagcacgaggagggacaggaatctaaatgctttgtcgcacacaccagagcataaataattatcaaagaatgcttaggggaatttaatttaattctgcatgtaatgaaagatgaaaaattatcttttccattaacatcaattgcatcaaaatcagtatttttataattttctcaacctattttttttctttcaactggcgaagtatcaaaaggcaataaagagaaaaaaagtacttccagatggttggtctaagcaaattacatgcaattttcctttaaataaaatggaaaatatatgtaatagaagccctgctgaacacctatcaaatcaaaatgattactgtctgcaccgttgtaattcactcactggtttatggcctcactctatttcaaagagtttcccaaattcatataatgttctgcagtgctagagctggcatcagatctctgatgtagctgaaagatgcagactgtgaaatcttccattgttggacaactttcttatttgggacatagttgagaaagctgagcagccaaaaaataaaataaaataaattgtcctttcaaaggcagctttaaagtcgcactcactcagctcaataaactctgtgtttcaggggtaaccacaaaaagagaagactttctacttgttgttccaagtatacattttacactaaaccctatgctatttagagagatattggtaaaaaattatggcagtgggtcatcagatgaggaattccctctcaaaacccttctagataaactgactctcaattcccccaacctttactcaagaaattggattttatgtgctccatccttttaccctaaaactcattagtacataaatgaggagaaaaagttgagaattggagaggtgggaggtcagggaagatagagggtcactgggggagtggactgtccactctaacccgtttctgatcactggtatccacagaatgaaccccaaagccatcgcccatcaaagggcaggtcccacacttcccagcaattagatccaggtggaggtgagcctctggtggggtggtgcggaagggcagagccaggtaaccagggtagtcagggcatgcctacctcgcccctaccccagagcctctcacctgcaaactgggtacaagcagttggtgtaaggtcaggaatgttgtcaaaggcaacatgaaagttatagtgtatcaagttcaagacctggacttcacagatttatggctacataaatacacacaatgtctttatgaatttgcccctgcttttaatttagtaagagaccttcaaagcaggagttcaaaaccaggggcaattttacttcccctcctcaggaacatttggcaatacctggggacaattctggttaccacagtgaggggatactacgggtatctgtcaatagaggccagtgatgctgataaatttcctataatgtgctaccctcactgacaagaagggattatccggtgcaaattgtcaatagtgccaaggttgaaaaactctgctttacactgaaaaaaagagagatggaatttaggtagcattatgttctgtaagtagaaaagaaattggtaagaccagaatctcttaccactgaaatgtttctcagctgctaaaatagggagcctggtacactcattgaacagctttctaattttcttttatatcctacacagattttctctttattctgccatgcagaaaaataagagaggccatttatagcaaccatttgaattctctcctgtattattttaagatgctgctgcttttacattttgcccataagaagttttactagaataaataaaaccagttgtacacaattcacagacaattgttttccaaaggatttttttagtattataagctgtaacctctaattaaatatgtgatcccactggattttatacatagaatatagttaccatatttacgtgtgcacattatccactttactaacttttctaaaatttctcacataaatctgaatttttaagccttaagtgggatcccaatttgtacatttttctttcaactatccatatcttttgatagtgaatagaccagtcctcagttactccttagcacctcctatatttgcaatgcaggacccagtgattacttctattacttctggtagttctcaaagttacaaggaacaagaatgatcatgaaggttcaattcacctgattccataatcacattctttgctcttgagacattcgccccgttacttctgtgccttgtctttatcaccacaaatcctccgatcagcacatcccttgcctatcagcctctctacttaacaacttcatttttacatttattacatctttcctgccagagtcagtttggactactataataaattaccatacaccaagtggcttgaacaagagaaatgtatttccctctgtttagaaggctggaaagctcaagatcacagtgccagcagatgccatgtctgagggagctcctttcctggtttggaggtggtgtcaccttttgtatcctcacatggcagagcagagcacaggagcaagttctccagtgtctcttctttttttttttttttcgagatggagtctcgctctgtcgcccaggctggattgcagtggcgtgatctcggctcactgcaacctccgcctcccgggttcacgccattctcctgcctcagcctcccgagtagctgggactacaggtgcccgctaccatgcccggctaattttttgtatttttagtagagatggggtttcaccgtgttagccaagatggtctcgatctcctgacctcgtgatccacccgccttggcctcccaaagtgctgggattacaggcatgagccactgtgcctggcccagtgtctcttcttataaaagcactgatcccatcatgagtgctccactcttacaacctaatcacctctcaaaggtccaccttataatactatcaaactgggtgttaggatttcaacatatgcattttgaggggacacaaacattcagtccataacacttcctatatgcaaagcagagcaaaataaaggcaaatactacattttcaaagttatttgcctcagtagcatcagcatttggttccagctgtaatcctcagccccctcccatgatggtaatcaaaggcttgccatttgctggaaattcctgccctgcaataggagtgttcttcaccctctacatctgacaactgccctccacagttcacaaatactgacggcgcactaaaccataagctctttaggaacaggaactctgacatatatgtatttataccccggagagtaatcaaattgtactacatatactcctggtgctgatgaggaccagtaatgagacagatagaatgtatccagagacatctgttggtgctaagaagggctcaggcaggtaataggcatcctaaccatttaggacaaagtaaaggacaaataaatctccaattttagtcatttattttcttccgctagctttcaggttgatgtgttctttcctagttcctttaggtacaaagttagattgttaatttgaaacctttctaaacctttctaacttcttgatgaaagtgtcttggggctacatgctttcctcttaacactgctttggctgcatcccagagattttggtaagttgtgtcctcgtattcattgatttcaagcattttttttttatttctgccttaatttctgtgttcacctaggagttattcaggagtaagttgttcaatttccatgtgtttgtatagttttgagagatcttggcattaatttctatttttattgcactgtggtgtgagagtgtccttggtatgatttccaggtttttgaatttattgaggcttgctttgtgaccaagcatgtggtcgatcttagaagacagtctgtgtgcagatgagaaaaatgtatattctgcggttgttgggtggagtgttctgtagatgtctatagaaaatgttttggccagagtgtgtgcctcacttagaaaggaaggggaaagatagaggaagggcagtgcaaagtcatgttcaatggtcatggtcagtgaggcaaaactgcatctctgagctcaggatgaaagaggatgaggcaacgatggtcgaggatgctgattacatctcctaagtacaggttttaaacatgcacacatctggtcaacctcttctgattgtgtgcaaacctaaggagtcacaggtgggccctgataaggtcatgagataaaatagggggctttatgtttcctagggcatgcatgcacacacaagtacatggcagatttaacattttataaatgacacccaaataactcctgtttatcatctgggagcattccatttttttctcaagaatcattgtatgacaagatatggcaaagctcaaattaaatcaacacaacgaataaccaacaaaaacaagtgaagtttcagaagggcaaattaagaacaacttttgtttttctgtggtgtcacacagagaaaagttatgtctagagtagatactctttgatgtacatcccaaaagctctattagcacatctgcagccaaaccactggtttcaggatgtgtactgttgggcccctcggtggccatattggttccagatggagttcaaataacataagggcctttgttcccgggctgaactatttcatttctccactggtaacttgcacacatgatggagcgctccatcatgaacgatgtgcaatgcccaggggtgcttcaaaaaatgtaccacagagactgctaaaactcatggaagcccctgcttttaagtgatagcagcagcatttgccaacagagtggtgctagtgggctgtattacattccatctttgtttatgcaacacccctggaataaaaagttaggcatttaccattataatttaccttaattatagtatttgtcactacctgtaatgcacaaaagaattatggtagttgcactcatagaagaggaaaatgagacacagggagcctttttgacttgcacagggttactcctatgctggagagaaggggaaatattaaataccttacatcaaatacctaagggcagacttaaggatttctaatccactgctgctgactgctggtattttaagacgggaactttcaaagaagaatgaatgttgtcagaaacatgattcctaacataaggaagcaatgactgggggctgggagatggcctatatcccttgtaagagtattttgagccctttagacaataggaaggctctctgacagtcttacttgtcaccaggcctctgctatgtccagaacaacagggttagaattcatggccccgccaggcatggtggctcatgcctgcgaccccaacactttgggaggtggaatcaggtaggtcacaaggtcaggagttcgagactagcctggccaatatggtgaaaccccgtctctactaaaaatatataaaaaattagccaggcatggtggcgtgcacctgtagtcccagctacttgggaagctgaggcaggagaatcgcttgaaccccggaggggtaggttacagtgagtcgagatcgcgccactgcactccagcctgggtgacagagcgagactttgtctcaaaacaaacaaacaaaaaagaattcatggccacatttccaaaatcttcatacttttgcaagctcactgcctatttcagggccatttctttgaacttatttcttcccctacccacataatcagtgtgaacagtctagtgtactgccttctgtatcttcctccatgtttctgcaataacatacaaatacaggtattcagacatgggggatggaggtcattttactttataatttgagattttctcataatatcataaaatctctccaagttaaccaggtatgattaaaattaatctttaatcacatctgagacattcttacaacataactgacatataatctatacttgattggtacacattcaatatgtgagatcaatttttgggagagaggaaaggaagcagtaaaaaagcttctataaacattcactatacatgcccttatatatgtatgctggtatttttatttttacaatatatatgccctcatatattatatacgggtgtttttctttgtatagtacatattcccaggggttgtaatactgggtgaaatagtttgtatatttttaattaggattatcaaaccacttttccaaaatatgtaagtaattcatgtttccatcagtcatgggtgaaagtcccctttaatcagcatccttacctgtcatgggtgttatcttttttctctctctctttttggccagtcagaagaatgatatctcatttgaattatcctaagagcaatggatagaacattgtttcatctacttactggacatgaggatttgctcttatgtgaactacctattcatatatttttcaattttcttatgggctgcttgaatttttctcatcaatttgtaagagctctttgtatattagaaataccaaccttatgcctattgcaggaattgcaaatattatctctatctaatgttagactttttagatggtttatgtcatcttttagcacagtttagtttaacgataaccaaattacagtctatcccttaagttgccaaaaagaaggaatcagcagaaaattctcgttctgcaattactaagataaaacatccagtgaaagaggaacttggaaaagatccagtacaaataaaactgcatgttcaagaatgctttcttaacctttggcacagatgccaccttgccccctccttggcttataagaagctgtcatacaccatcattaacacagttggtctcacccttcaatgcagatgttatagggtgctgctcctgaataattcttcaacctgggcaacgcatttaaattgggaattttcagctataattgttactctctgctgtccataggatgaagtctttgacccgaacctaaatacagaccagaattctgagcccaaaaactatctccagcatccggagaagaagcatcatgaaaggggaggagagagctgtttatatataaaataagttgaatttgcaagaaagaaccgactgtctttttctttaaaaattgtaggtagtatcaaagtttttctcctctttacagataaaaacaaaaaggctaacggaatgcagtcgaccgagaactagtttcttacatttccattgagggtatctttctctagatctgtcatttttcagaattttccaagtaataaagtcacaggcttttttgttaggtggctggaaagagaaatgtatttgtcattctgtctgatcttccaaagcatttttcagtgttgtttttgttgctgttatcttgttgaattttttatcagactattattggtatcaccaataaagaggatgttgaattatgtttctcattccaaaaatagtgcaaaaaaattaatcttaaaaagtataatggaatccacttttctttcactgactccatctgcaagccaggatcaactgtaaaatcattttatgaagaagcaatattgcaggggatttattctctgggtctaacagactgcttgcaagccagcgttaaagaccttgaacagttgatgcaaattccacctttgtattttactgccctcagtgagctcaacatcattcattaaagggtgtattagctgatatcttaccaccgccatgcagcagagaaggagaatcacataattttaaaattcaggctgagggccactgtggacgcagaaggctgacttccgaccacctgcttccccactagacttgttccaaatggctttcttgagaggtgattcacaagtgctaaaaaatcacgaatttttaaagtgagatattttggattacttataaactactttccgtaatggcattttaccaatgaaatgatccactggatgaaaatgacttatccttagttatctgttttattcctgagctcatctattttgacaagttcttgatcattgtgcagtacaaactatgcgcagccttttcacaaaggcttccctatggattctaggagctcacaacccaccgcttctcaacagacagtcatatattctactttacagcagaatacttctgcctcagggaatcctaatggccagtgccaaatcttgttttcactaactgtgagaaatgtgagccttatgctttacattaataggccaaatgtatttctctttgatagaaaatcaaacttctaagccactgataaaactctggtgacatcctgagcttcacaggtttgatcctcttacaaaaggtgtgaacaatgcaagtgaggttaacaaaaatccttgcagggaatcacacactgagtggctctctggcctgcatcactaactgctgcattttattaacagcaggtcaaagagcctctcgcccaacacatcacaaatgttcacagagattcaatgagtcaacaagtatgcctactgcagctggaactgacactgaaaatgtgaactacattgacaaaaattctcagcaggcctctcaaacacaaacttttccctagcccaaggtctctggggaaaaattataacaattaaaagtgcagtgtggagtgagaacacagtgcagcaaatttttaatgtcagaaagtagcaatttgataactaagaaaactggaaaaatcattataacctatgccttactttgcccagcacctcccaagactcaactggaaagagcctggctttgagaagaatgaaagcctgaactgctgattgtgagaaaaaaaaaggcaaaataagtgctgaaaggaactcacatcaaatatttcattgtaagagtctgatcttatttcctatagccagaatggcatttgacgatacaacagtggagaattttgctactaagatgttgaatgaaatccctcaagaggagaattacctttgagattttctgtcacttttaagatcacttctgaagtatcaaagcactactatagcaaatgaaatattatgaggagctttgcaacagatgccaataccttcccaaacatgtctgaggcatctcctaggtcagaggccctggatttcaaacatactgccaatatgtcaatgacccccagatacacagctctattcccaatcattcctcgatagcccacacttgtgtatctgtctactctctagacccgatgagaaatgaaagccttcaactcaaagttaacattgccctagaagaactgttgcgtttccctccaacccctatacctccccagggcttctctgtctcagtaagttgtccaccatccactcacttactgaggtccaaaacttccaattcattcttaatttatcttcccctctctccaatgcccaatccatcagagcaccacagactctacctctaaatatgtcaagcccatccacttttctccttctacactaacaaccctgtagtctgtgccaccatcacgcctgaccccatcatctgtgagagcttcaagctggtcttcctgcttcccctctagctaccctggaatccattctctgacccagtggtgaccttgataatataaccgacaatttggaaacgtaaataactcatatcccaccactgcttctccaaagggttcccaatgcccctaatagacatagaagtttcatgtcccggcttacaaagccctacatatgctaacccttacccacctctgtggtctcaattcacaccactgtccctttccccactacacacaaaccaatccaaagttgtcccctgttcactctctgtcacatgaacccatctgaattctttgcatagcacttaaccactggacaatactttttttatttattgtgaacgcaattattgcttatggtctaactcttccaccaaaaatgtatgctcagagagccaggagcctatctgtcttgcttacgtgcatatcgccagtgcctaaaaccgaggctcacacactacatgtgttcacacacacacacacaaatacctggggaggagggagaatgcaagttatttctcatggtcactttgactgcaattttcaagaaaagcagtcagtgtgtgacagcaacagtagaagcacgatttccaatcagacattaattgagacgaccactagcccttggtgaccccatgtacaggaagagatgtttcagggacaccatttgtttatacagatgtctgtccttaagggatttttgtttgaaatcaaccaccaatcatgtattttctgcaaggaaattacacagtaagggtgggttccaaccctcaaaatatttgctagctcagtgaaataaaaccaagattccatttggagaaacctatagctgctttactttgcaataaattgtaaaataggtgggttttattgttttataattcttttctgtaatagtctaccaagaggaatcccttggggacctttagaaaataaaaggggtaaaacacatgctgcattaagaagttatatattatccactgggctcagccatgcaggaggcctcagcatgaccttggcaagtttcttaacctcaccacactgttcactcacctttaaatggggataatattagaacctgcatgcttgttgagaagatgaaatggcatgcataaagcagtatctgggacacaggaagtgctcagataatgtaagcattatgaattatcaccaagttattagcagtgcttcaaaaaatatttcagatttggaaatgttggaaaatccacattattaaatttgtattgtggccgggcgcagtggctcacacctgtaatcccagcactttgggaggccgaggcgggcagatcatgaggtcaggagatcaagaccacggtgaaaccccgtctctactaaaaatacaaaaaattagcctggcgcggtggcaggcgcctgtagtcccagctacccggcaggctgaggcaggagaatggcgtgatcctgggaggcggagcttgcagtgagccgagatcacgccactgcactccagccctggcaacagagcgagactccatctcaaaaaaataaataaaataaaataaaataaaataaaataaaataaaataaaataaatgtgtattgtcattgctacattacaaggaactgtttaatgacttgctctgagcatgttcaagtgctcctttggctgcaaacacagatgactaccgcaggcccgtggaggtgacccaggattagctacactctattctttctacacttggggaactggcatgtgcttaagaaaagacaagaaaagctacttcaaatcaataaagtcttcacaaatcatgcacacgtgattagaaatgttcgttctgggtgtatctgatcatttagtaattgctcaagaaaacaagaataactttgtacattatctgccataaagacaaaaaatgagcaagaaaatgagagtcaaagttagaaaacaaacaaaacacttaatattataatcagagaactgagtcacactgtcataattcacttttttattgttgctaatattatgatgtcccagaagacacttctaagacatttacatagaccttaacacctggtttataaaataatattaaaagaatatagtccagtacataaaagagaaagttattttaaaaaatgaaattggccaggtgcagtggctcatgcctgtaatcccagcactttgggaggctgaggcgggtgtatcatgaggtcaggaattcaagatctgcctggctaacatggtgaaaacccagctctactaaaaatgtaaacattagccaggcatggtggcaggcgcctgtaatctcagctactcagaagggtgaggcaggagaatctcttgaacctagaaggcagaggttgcagtgagccgagatcccgccactgctctccagcctgggtaacagagaagactctgtctcgggggggaaaaagatgaaatcaactcctagaaaatactgcagcagaatgataaagtaaacatacaactacatatcaagttgagtcgagaagaaaggaatttcaggaaaatacacaaaaatgatagtggcttgggagaaaagaatagacctgcctatcaaagcatgtgttggttctctgatgaggtttcagcctgagaactaacatgggaaatgtgctgtccttctcctgctttactaaccttctgccttcttggttggtgcatccctgtgccgggctgatgaatacatcacaactgctgctcacagctgggaacacaaccagtaataaggcacagttatagcttcagggatgtaaggaaggtgagtgactgtccatactgtgcgtgtgtgtatccacagtcacacatgtgtatgtagcaccaagttagtgaaaaggttttatttaaaaggtgctacctaggttgtgattttcctctagtaggtggatccttgagcagcctacccctaatttgccacaaattcataattaagttacatagctgggtgttagtatactgttttacatatagatttcagagattttaaccctgccttagtgcacctaatgcagtagggtttcatccaattataaggctttctctatctgtttctatatctatttatctatctctatataatttacatacatgcatttatataggtggatattctatctttctgtttattcaactctatctacatatattacatatatgtgtgtaaatatatatatgtgtgtgtatatatatatatatatatatatatatattcaactctatctatctatctatctatctatctatctatctatctatctatccatccatccatccatccaattgacccagaattgtggtcacagcaaggcagatactcttaaacattagtgctgtcctctggacatgtacatccagataactatgttacaggaaatacaatttcagtcttctgagcttggctcaccccacaacctgacagtcatgctgtgctgcgctatttttatgtttaatatgtactccttgaagatgatactatgaaattccactgtaacactgatagtgttcaaatgctcactttaagaaaggttagatgccaggaaggaagtgataccgaatcctacagtgcaggaaagcagctacattggtttcggtcttggtgctatttgaatacctcaccttccttttctgttctcttctacatctcatagataaccattaataagaaacggactttagaaggatctcacagtctttcctgtctttggtacactgtaagtgatgttcaattacactggaaaacagtgaagactatttgagaaagcagtaaaatgaatggccccagctggacaatatggggacagtctataatggctacagcaaatataattatttaattattgtaaaattatgcaataaacttcttaaactaaatatagcacaatcagaaggctagagcagtacatttaatcacactcttaaggaccattagagaagttatattttacaaaatttccatctgaatcacttcattaaataacatatacgtattcagtgcttattatgtgccagagtgttaagtattgggaagacggatgcaataatcaagccaaggacttcacagtgtgaaaaggaaggactatatgtatttacaaaatactacaatgaatcctactttaaattgccattgcagggatgtgcacaggagtgtggggacacagagggggtgtgacttaattcatccggccatggagaaggaagagaaaggttcatggaaaatgagacagattagctgagaactggtgaacaagcaaatatctacccactgaacaatgtgggggaaattataccaaatgcatgaatctctgattggggtgggggaggaagaatcccattcctcttctcttagccaagcccatagccttccagctctgtgtccaaattagaaatagggtattactcatgcgattcagaaagtcccagaaaaatccatccatcaacccatctacacaacaaataattattggcatcttattacatcttagtcccttacctcacctaggaatggagcagtgagtgaacaaaataagcaaaatccctggcagggtagagcttacatgagaaggcaggggcagaagttatgtaaaattgataaacaaaatatctcatgtatcagacagtgctaagttctttacaagaaaagcaataaagcagaaaaggaaaatagagaatagcagggagactttccattttagtcatttgatcaggaatatctcctgacaaggtaagagttgaataaacttgaagtaggccaaggagcaatcttcagggatcttcaggtaaagagtgctgcaggcacagaaaggagtcagaatgaaaagactgagcaaggaaagtggctactctgttccagggagaccaaggaggccagtgaaactgaagctggtgcttgggagagaaagatagatagagaagagagaggatgaggacaaagaagggacacgtggtgcctggcgcaccaagggaggaagctggctttccatcagaataaggcagcagctgctggaggattctcagcagagagcctgtctggtcactgtgtggagaaaagaccacggaggcccaagagcagaagcagcgagacggccggaagacctgagaactcacggggaccaagttgctgggagcttagctgaggcagggagcagtgaaggtgctgagaagtggtaagatattggatatatgttgaacaaaaaaacgaacaacaataagatttgttgacagctgggatgtggggtgacagagaaagagaataatcaagtattgttccaactgtttcagcctgagcaagtggaagactggacttcccattaataaaatgaggaactctacagaaggacatggctaggggttgtggggagaaaagagttcagtttggacatggttaatttgaagacataaattagacatccagttgtgaggttaaataggcagttgaatatataaacaattctggagcttagggataggttttggctgaagatagacatgtgggagtaattagtgtgcaaatgatactaaagccatgagactggaagagatttctaaatggtgagaatggtgggaaaagagacaaggtccagacactgaaccttatgggactccagtgcttggatggcagggagatgaccatttgaggctaagatgcaaagcccagagatatgaggtcaggccagagaaatggagcatcctaaagccaagtagagaaagtatgtcaaggaggtgggaggggtcgatggtataaaagctgctaactgttaagtatgatgatgactgagcctcgactgctggatttagcaacatggcggtgttgggtgatcttgactaggcagtgctgaaggaatgactaagggatcagactgggctcaaaataaaataaaaaggcagaaatggaggacaacaagtacaggcaaatactttaaaccaagttttttttgttttttgttttttttttagcaaagaggagataaatgtattataactaaagaggaaattagaggccacaggtcaaattttcttaggatgatagatgtttccattcctattggaaaaaaaaataaacagcatagagggaaaaataaaagctgattatgtaggaaagaaaggaaataactgcttaagtactgtaggagcaaaggaatgggatacagtttggccaaactagggttaagagtttccatcagaattaatcagtgtccactagctggaatattgtgattggcccacttgggtaggtacctcacctttaaaacatcactgtagtaaggaggtggcctgcaatgaagaaaagaggaacagttctcaaaaagtatgtggcccctgagctgtgataagggtaccccaatttatatgtactaaaaaaaatctgagctacagtaaacaacttagatcaacccacttaattcctcagcactggaaatgtaagtgcactattcttagatactgttacatgaaaatgtggtgatatttacttcccagaatctcccaaccaacttcccaacctttgctttttctgctttggtttaaccaatagtggttactgctcaggctttaaacaaaaacaaatgaagcaaaatgactctgatttctttgtggcctcggaggctcaaaaagacacaaacacacatgaaacccccactagctttcctagataaagcatgaactgattaggtttgcagccctgcagctatagaggcctctccaatactctgatctggaaaccacagggcaggaaaatccccaaagtcccatgaaatccaaagatccaaacgtggggtcgtttttatgccctcaggaaagttctgccaaaaaaagagatcttacacacagtgtaattgagagggcagtatccttacgtgcacatgtaaatccaaatccaagcaattaaccccacacacatctgcccctctaatgggtgtctgagaataaacagcacacgtcaatccctcccagcctcactcaatcacgaaactaagaaaagaaaatgaattctgaacttcaccacacagctgtgattcacaaatatttatagtagccataaagctggtgaccttcaggaagataacacacttggcagacattcacctaaacaaaagaggggaaaaggcccaaatctcaaacagcagagaacagagagagaggcaagatttcccaagttccataatggggaattccaatgcattctgatggagataatggaagctgacaattctcctgtcagtgagctttggtaagcggagtgaaatgcttgtgacaaaacagatcagctctgcacgggcctttctggatggcctcacagagattttccatcaggctgagtacacaatcggatgggactcaggagtggtgtctacagccctgtatttctgacattattaggaatgacaggctaaacctttatcccaaattacaaccactcagcatgtttaagcaagtgtgtaccttgtatcaacaatatacatagagatgccctgaaaatatcacaaaataaaattcctttcaggaacgtggcaccgaaagaaacaccgtcagcaactcagcaagcactttttttttcatatttggtctctttgtctagtttaaacccctcattacctattatcacacccaaacctatgtcttctcactttccttattttatagccaagaaatctaacaaaatcaagacaagtaaagactgagagctgactcttggtccgatctgtccacggtcaggtggttatgaatctcaaaaagcgagatctagattcaatcttttggaactcctgcccttaacattattgtacgcacatcacaacaaattactattttacatcagtgctcgagactgcacaaacgaggacatcttatttgtgatttgaccagccttaacttggtctttgatacccaccatgtaacatttaatgcaaacaccttaagttagctacaagaatgagccaagaagcaaagcactgtgatcaggatttaatcatggttaatataatgggttaagttctataaaattttttaaaaatgaaatatagttgttaaaatatagtcataggttatataaaatcttaaaatagaaagttcccttctccctaacgaagaatgaataaaagaatgagaaaatttaagttgtctggttctaaactaggtctctatttgtagaaaggagaagtgtgtttctgggattttctcccacttgtacaaatattgttattgtccgaacatccacaataaattaaaattggggattgatttttttcagtgaggacaaagaaaggcagaataaaacattgagaaggttttaaaaagcaaaactatattttaaatatctgttcctgaattaaacagttaaatatttttaatacaatcagaagaaagtaaagaatttttgttcatttttttactattcccattttatagatgaaaatgttttgttttattcctaagcactgattaaaatcattatcaagaaaaaatctgacatcactaaaataaacttatttaaatttaaaaggataaagcaaacaagcaaatgaaatagcggaaaaaacagtgacaataatgagttaatattcttaataattaagccttaaaatctgtaagaaaaatgttgagtctctatagctaaacagttataaaatctggacaaataattctcacacacgcttgtttgtctctgtctctctctttctctcccacccttccctccctccttcccttcctcctttctctctttctctcacctcttctcagagtaatggctaattattgcttgaaaaaaaattagcaaagaaacacaatgagtaaaaaataaaatatataaaaaaagaatattatcaaattgactaaaacaattaataatactactcaaagtttttgagtaatgatattcaaatttgttttagcaaaataaattctccagcatataaatgaagtataaatatctacaatacttttacaaagccaactggcagatttttaagactccctgggttttatgtagtaaatcaaccatagctcttctgagctaatgaattaaccctcaattaaaagaaagtattacaataacaattgctattgtttttgaagcatgtacttcatgcaccaaatacagtgacctgctcaaaatgagaaagcaggattggaactcaggtgtatgaagtctcccatcacccttttcatgttcatttcagcatggtctatgacttttgtgaactggaagcaacatatgttccacaaaagaagcaggaaatgacattacagtgcctttacacgatagagtattacatatacattaaaacaagggttttttcttcaatttgcaataatatgagaaagtatgtataagtgaaaaagcagtatgcagaattttatgtctagtattatctcaactctttaaactgcttatcaaaaatattccataaaagactacattaaatgtcgtctgtgattgtcttcaatagaggcattatagttgaattttcctcttcttttatatattttcagtaatgagcattcactacattaatgcactttaaaaatttttttaattgtaaaaataataatactcctgaaaatcttactgaccacatggatgataaagtgcaaacacctgtactccagagataatctctgtttagagtatggtatatattaatatatattctaggagactttataatacacatgaacttgtgcatagagattgtgtgtgtgagtctgtgtttatttttaagaggaatgggattatattaaatatattattctgcaatttgctttctcagttaataaggaatcaaggatagttttccattacttttatggtcagaatttcattttttatatcattgctattaaggtgaagcacactttgccatggcacatggaataagtacctaggggccagtgctccttgacaaaggcatgtctccaaaacttctgctatattatcaggctcttgagtttgctgcaattatagatttctaagaatgaacgaatgaatgagtacaatagttccttgcttaaattgcttaaagaaacacaaattaattggtctttcaattttctttgcccatctttgtaaatgatatagtagagagtcaaatatgcctttaagtatcagaagtatccgtttgtaataaaaaagaaaaatttaaaaaatcataccacaatttatttatgtggcaaagggtattgccatgttatttcatcatttaactatgtcaatcctgttcaaactccatctttgctcataataaaagagggatattcgagaccagaccagaacattcttgttcaacaaaattatcagaaggcccaagataattgcatgtttaccctaatatatataaaaggcagtatgtataagggtgcaaactaacagtgtcacattcagaaactatataaaaaccaaagtaggaaataccatctaaacttatttcataaatgagttatatataccagcttaacaaaatgtcaagaaaataatatttaccaggccctaatttgagcaaagctgtaatttaggtgggacttagactaacacatttggggcatataaaccatgtcaagcaatagaacatcaaatgtccttattctaaggggtaaggtttgcagttacaatagacttcaataaaatttgtttataattaaaatccaagcatccaagataaattgcactgtgggactaatacctactgtccccgaaacactctcattcactatactatgaggtcttcggcagtgcaaggatcgtgtcaatcatagctcagaaagctgcttagcctggaggccaaatccagcccaccacctgtctttgtaataaagttttattgtaacacagccatgcccattcacttacatacctatgactgctttcatactacaacggcagagtgatgcagcagagactctatggcctgtaagcgccaaaatgttttctcacactttttagaaaacgttcgccaattcttgatttagattactgtttgaaaaactgatttcttaatatttgttctgagtttctctctacaggtctgagtaactccagtaaggaataaaaactaaaatatgactgttcttattctagggaggcatggttagtgctaaaaggcagttttctgtaaaggttaagaagatagaatcaaatcccagctctgcctctgactcactgcaattctcttgcagattatttaagctctctgtgcctcaatttcctcatctttaaaacagtgacccaagaatacgaacctgaaagggttgttatgagaattttaaacatctcactcagcacagggcctgacacacaatgaggacttacattagctaataactcttcctatcatatatcatgataaccgctgaccatccaaagcaagccaacacaggctccatgtggtcattcttccagctctcaggtgctgtggttctccatgggggagggaacgggaggttccggttaagacactatgtgaacctgaatctacgtgggctggagaaagatacaaaatgcagacctccgtttcttcttctgcaaaacgtaaggacgacacaggagaacctctcgtctcagctgagcacatctacacatctatacagagggcccagctctaagacccatttagcctccttcctcatagacgaagccagggactggtaactcataatccaagagcaggaatggtcaccaattattcagaaaatctctggattatctaaaatcagcaaagtgttttgtgaatggggaaaaaatataagcctgtccacaatgagacggtaatttagttagggagaaaaataaataagttaataaacaatggtagtgtctttgcagtgactagtatatggaatgaaattgtcactttctctcactttacttgttcctcccctacacaactagtcctctatcccccttcaccccttcctctcttctagccttcccagaaggtagcaacacctaggtctaaagtgcttcagaaaggctcctgtgaagccagcatttctgagccagcctttggaagatccaaacaagcacgattcgtggtgggaacagatcattgtgaagtggggggtcagtccctacactgtcccagggccacaggaaggaggaaattgtgtggaggcctgaccaggaggatccctgagagtatcatgagaggtttagggcttacccagcaggtacaggggactgcagaaggtcccaggacaggaagtgagatgacagtggtatgcactgcaaataagtgggggcagcgcacagaggtaactgcaggagacaaaactgaaaccaggtaggcagtcacactggggcgcagaagatgctaagaagcatctaagccttttcacgtcttcgggttcctgagtgatgtagcggtggtatatgcccacaattgttttacttgaaagatttctctatctgaaagcttgctcattaactctcatttttttttcttttcttcttttcttcttttcttcttttttctctgagatgaagtcttgctctgttgcccaggctggagtgcagtggtgcaatctcagctcactgcaaactctgcctcctgggttcaagtgatcctcatgcctcagcctcccaagtagctgggattataggcacgcgccaccacgccaggctaatttttgtatttttagtagagatagaatttcaccatgttggccaggctggaactcctgacctcaggtgatcagcctgcctcagcctcccaaaatgctgggattacaggtgtgagccaccaagcccagcctactcttatttttaataacagaagtaaagctcacaagctgtcaaaaatatttcaatctgtaatttttttagtttcttcacttcccatttagatgtctcacttaccaaggagagagaggatggaggacgcgtttcctcaatcatgaatcacactgactccacagccacgtgggcactccagcccaagtctcacacaccaacacttcaaaaaagaaaatagagagatcctgtcaacccattttaaaagaggatgtggtcattggtcatgagttctatgaagttccattaaagtcctaaacaatcagagcaagctgctttggccacgtaggattaaagcagtgacgcaggccagcttggcatcacaatcatgctaccctagttcaggatcatgtgcactaatggattctttttcttcagaaaaggagaaataaaacatttaaatgctgttaacagatgaaataactctcataaaacatccagaagaaccattatttcaaaattatcttaaccagtctgaaattatctaaagcagtctgaaaattaaattaagattcattatatgaatttatccttttcatgactcattccactttttggaacacatggtaccttatacaattcaagaacaggagacaaaggcagtagcacaaactctgctagaaatttgagtttgtatttttatttacatactgatttattaggtgcacaattatgaggctttataggaaaaggaatgatgcatcgtgaaaaacaagccactttaccaaaaccaagtaaacctgtccaatctcgtcattcaatttcatatacaaaaattctgaaaccttgatgttgtcattggatggaaagatgaccacgaaacgccagcctccctagaaacatgtatgccagaggctgaaaatataggtgactttccatctatgatccatatgagaaatgtgttcatcaccagtgaaggatgcctgtgacttcaaatactgcatttcagggctcatgcttttttctgttctcttcattcatctggtttttctctacacttcccaggtggcagcttctggctgctataaatgtgaaacaccctgacattcttcctcgccaccctgaagaagggaaaatgggagaaagaacttcccagaacattctggctgtccctctaggcagtgattcccacacggtcagcttcagtcatgatccgaggccatctgcctgcagaaaatgaactgaacgacagcagctggaaatttataaaatgttatacctgctgaagtgccattttggaagccctagggttcagaggccagggaacaggtcaaggtggcactgcctctctatgagtctcccttcctccaggacgggcctttggtatgttcatgggaagcaagggggtgacccagggcaacacactgggacatgcctgcctgagacgccccagcagcccaggcaccctcatatcgtgcagcacggccaatcctccagtcccagcagagtcctcaaaagtccgtgacatcatcctttggacaggagaaggtgcagatgcaaatccttgaagccaaaagaggagccagggaagcacactcagtctcagaaatattcctcagagtggccaatttcttttacacaacatcactaatatcacctttgggcgtggcaacaaaatatgttagttgaaactcctttattaaatggcatgtttgaatacacaagcatcctctctccagtcctaaaatctattttacaacaattattactaaaatgtccttgtagttgtttagatctgagttgaaatgtaagtaataaagtttgacagatcctctggttaccgccatgaatagctggcaatttctgtaagttcccatgtctcagaactacattaaaaacagggctaataggtctcctgcctcccccagtgaggtcacaaatgagctgatgtgaaccctcagctggacagcaaaaccacacctgcagaatatgggtcagtctcttaaatgaaagagactggggccaaaaagatcattgcaagaattcacaatcagtaacacaaccagagagcaaatactgcaggaagaagacatccctgccgaatccagcatggacagcccacagcctggaccgccagacagtcctggtgcaaccaacagactccaaaacccagccccttccttgtggaaaagcaatacccacaggacagagctctcttggcttgggggaaaacacagcttcctacagagtttgatgtctaaacaggaaatcagtctcagcagcaggattcaagggtgtccacccgaaagggttgttactgtgcctgtgtttacataaatagtgaaaaagatattttaacagcctgggggcttgtcagccaagtgagccatgttgggactttctgctcctgagggtcagcccttgcctggggaagacagggtgctcaccaacacacccatgtgtgcctgggaacgtgcactcaggaacagaaatgatagtgacaaagcagaggccttgagttggagccaagctagaggaacagacaatgattcttgcaggtccagaagcagagcccccgtgtcctctcccagcaaggtcataaattagccaatgcattaatcataaatcactgacatattttctagaaaactgagaagaaagctgaaaggcaaagaaactacaaagccccagaggctcactccagactggaagttggaaaatttttaagcgacagttaactacccatttaataagaaactgcttattttttataaacatataaatttctctatttgactcaattccatattatccttattcttttctcttttagcttagctttaaccttggtgccaacaacctctgaaatcctctgagtcataattttcagagttctgcctcttaaaaaatgccaccatgaacatatatgtgcagaactatcttgacgacacttttgatttacaaacagtaactctttcccagaagttttgccctgtggccacctacactcttcaaattgtctctagatggaactacatgaagaagattgaataccaattataacttactaagtgctcatcagcacatgactttctgctaaaatatgcaaccttctccctgcccaacttactcagaatgaggtaagatgtagacttaagcattattttggagaccaaagttgagctgagtggtagcctttatcctgcagatacatggcagaaattaacatgccaggccagtcttatgagctgaatttagaaaccgtacaacagtaagattacactggaaataaaaatggacaagaccacctggcatcagaaagtttagtggagtgatgaaaagaaaccgtaaaagatacaggttcaagaaacctaagaactgctgggccagcatttcccaaaggcaagacttagaccagtgccatggcatttaattgacaggcctctcatcatcagtccctccgttaatcaccatgcacagcacagccccatggccacacatggtggatgcttagaagacaaaacaagaacctattacactctcaggagctgtctatatgatttttctgctatgtagttcagtatatactatgaattggaggaaagagaagttacttatgggcagaagagtcaaggaaaagatttctgaaaatgggaaatgtgatgtgggctctaagggatgaggaggagataaggaggatattaaaagacacagtgaagtatgttttagtgggtgcattgcaggtgaaacaaacagtagatgagggaggaacagctgaaagtcatcaggtataagagaagagccatttacgccagcaccatggtgagttaaagcatgagttcctggtaccatccctggagttgggtggaaaccccaccacggagcccaccaagataagagtttgcaggagtgcaaactgaatgagataggtgaaaaaaagcaattccacaaaggtaaaaatctggactgcaatgccataagaatcacagacagaaatctggcctcatgctcaagtccctggaggaagacaaggaagtaaacaggagggtggattccaggtggcaggccaaggagcagggagggtggcatcaggagtgtgtggaggcagccagcatcggctagcagcagcatgtgccacgatgactacctgcaagatcactcacatgcaagagcatggagagctcaaaagaggcactccagacagctaacagatgggaaaagtagatgacacacagattgtagggaatgttaacatgagaaagagatgagacttcatccaaaggaaggcagagtcactgaaggttcagtgggatgtcaggatgagcaaactttgggagggtgaatatggcagctctgcagaggatgcacaagacaagaaggggagaagctggggtaaaaagccgccaccagagaactccaggtatgaggagaattgcagtgaaggatgaacatggcccttgccaagcaaaggacttgcctttgccaagttcctgggaagtcacctctaagaccttagaatgtcctgcctgatgagagactttgttttgggggggctttaggccacacagatagtctaggctaaccatgtggttaatggctgagggcttgggcctctctggattagtctggccatgtctatgtggtcaattctcaataaaaactcaggacaccaaggctcaggtgaagtcgcctggttggcaacaccctatgcatgttgtcatacatccttgtgggggaagaagcactgtccacgtgtctccactggaaagagaccatcagaagctcgtgactagcctctcctggactccagctatgcaccttttccacagctggagtgtaaagggtactactgtaccctttgactgagatcaaccataatcactaatacaacaggttttacacattcttagagttcttcatgtaaatcattgatcctgagggtgcccatgagccacatggcaaacagggtcagggggccccacatgactaagtgtgcagcttcagccctaaacatcaacatttaaaacccaggagcaacaaatggcctatcgcattggaattattcacaaagaaaatatattccacattcccagaaatatattaactatctaaaatagattttaaaatatgctaaataaaaagtcaaaacatcacagtccatttttgcaaagaatcacttatatagaaacatcagtctaaaaactcagcatgtacttactgaggaatgaatgttcttgaatttagggcaataaactaaatgacgaaaatcagaattttctcagtaggaatgaaaatacaaaatgagtaaaggacactatttttggaattgccttcatccaatgccaactggtttgattgacaggaactatgtggaggacccagcactcagatgtgggctgtgggataatgaaacgccattcactctggttatacgcactgcaaccctttctgtcactgtccgtagcctgggtgtccaggcttccattaggtcacttctgacagcctctgtcacttgttccacaggtggtctccacaggaatgtgcttggataaatcgacagtggacatttaggataataatgtcccttgaaagaatggcaatctctgtggctgggggtccttggaaaccccagccactcaagaaaacaaagagtgggtgacaggaacagagaacaaggctttgaggcaaaagttatagggaagaaagcagagagaggggagaggggaggaagagcaaaagaaaaggaagagggggaagaaaaacaccctagaagcagctacagggataacaggatgtcctgaaatggtgcagccaactgaaaaatatgatataatctatcattataaaatggacttttattgtttccttcaacttttgttaaaataaattttatggaaaactgaggtttacaacatgatgtaatgggtgacatatagatagtaaaatggttactctagtgaagcaaattaacgtatttatcatctcacatagttacattttttgaggtaagagcagctaaaatctacttatttcacaaaagttctaaataccatatatggttctcacgcctgcattagtatctttgaaggatacaaataacagcaatgtcagcttcaggtacgagggaggagggccagttcctggccattcccttccactggcagaacgtctgctgccagctaccaccacattcctgggcaaatattccagcattcaaggaaacaatttgaaaaggaaaagcaaaatgcacaaaagcttgaggtgatgaagaaattataggatgaaggcagcagccagccccaaccactcttaccatggtccagggagcagccgcataccccaccccttctctcctctacaggccagcactggctggggtcagaggctgatccatggagcaagtccattgagactcccaaatatgagattgctggccactttacattcaagacagggtcaggactcaaatgaaaaatgatgtaatttttaaagatagatctctggatttgttcaatatcaccacttaaatttttttttagtttattttttttaattttttttttatttccaaaggttattggggaaaaggtggtgtttggttacatgagtaagtgtaaccaaacttttgtggtgacttgtaagatcttggtgcacccattacctgagcagtatacactgcaacctatttgtagtcttttatccctcacccgctttccaccctttcccctgagtccccaaaggccattgtgtaattcttatgccttttcatcctcataacttagctcccacttatgaataagaatatacaatgtttggttttccattcctgcattactccacttagaataatagactctaatctcatccaggtcgctgtgaatgccattaattcattcctttttatggctgagtagtattccattgtatagatataccacagtttctttattcacttgttcattggtgggcattttggttggttccacatttttgcaattgcgaactgtgatcctataaacatgcatgtgcaagtatctttttcatataatgacttatattcctttgggtagatacccagtagttgcaccacctaaattttgaacggtatttgacattgtgatgtctaaatgctgagagcggagttagaaagagatgggatatagtgggcccatctcttaacggtttttctttcttaaggatgttcctttgcctcttggtttgcccgcaccggcctgaatacagaatctgtgcaggaccccagccaagctgtgcacagacaaacaggttctgaatgaagtggtgtctctagcagggacagcactgatgcaaacacccatggcttacacattagagaccttacacaaaatgtgggacaaaataaatgcacagagaaagaaaacacacacacatatttacaatcagatcgttatagatatccaataatattgcattccaataagcaaataaatggccttactttccacatcagcttgaacctccaatcagagaatttttcctgcatcccagtttagcatgctggatgttgtgctgaatgacgtgcataacaccacaatgacatgggaggtctctgccctcaaggaattcagcctttggaatcgcttttccccaaatcagaaacaatctcattaggaaccagctaatatttgatctagaaataattccacatatttaccaagaacatttaataaagaatcccttcggtaaatatctctcgtgccattaaaaaaaaaaaaagtgggccgggcacggtggctcacgcctgtaatcccaggactttgggaggccgaggtgggcggatcacgaggtcaggagattgagaccatcctggctaacacagtgaaaccctgtctctactaaaaatacaaaaaattagccgggtgtggtggcgggtgcctgtagtcccagctactcgggaggctgaggcaggagaatggcgtcaacccgggagacggagcttgcaatgagccgagatggcaccactgcactccagtctgagtgacagagtgagactctgtctcaaaaaaaaaagtgtcagatgtgagattccccttcactgagtctctggctcccacagggccaaagtaagaacacctggagaccagtcccagaggtcaaggcctcatggacaataagtccccatgtgatgacacatgacctcacacctgggtcatttaatcatgcaaatatctggctctatgactggcaggggcaagttctactttcctgtacagaagagcaggcacttctacaagttgtatccaaagagtaagatggcatgaaagagaaatactcttcccacttggagccttcatgcccagatccagcctgagacccctctctccatcagacagtagtcactgtgaatggaatgatctagaaatattaaacatagctccgagctaaagaaaaataaacacagtaacaggggattttgtttctcaaagcattgactaatcctaacaacagtttggaaggaagaaatccaattgttttccattttgtcttcatgcagattatcctttggtgaatatttaaagctagtagaaatagctggcactcagtattgcctcagtaacggaaataaagctggagtaaacacttcctatttcattactctcacatgagacaatgatgtgttctgaactgcaaagaggcatggggctgagggaaagaaagagagggggcaaaaatgacttctttattaaagcaaacaggttgccaaaaactaagcaagtgctcaaaatgagcaatttctgttatgcgctctctaaggacaccagggcctcagaatagtgaatactttcttattttggccaccatgtgccagattttcaaaaggccacctcacttttcatgcaggcaattttgaagagcttgcacaaccagttaatttgcaaggacagccggcctctgggcttccactctgacagctaaattgatcaatcctttgtagaggaaaatctcagtccctagaaaaaaagggtgtctgagaccctttgaaaaatgtggtctctcaattcctacttattcagaactacacagccaacaagacttattctgtaagcagtagtttgcctacacaaaggagactcaagatttaactctagatctaaatttaagatttaattttaatattaagatttaactctttaaaaaattatttgactactcttgttacttaactatctctgttaaaacataaaaaaagggctgggttcttatatccgccctctggtcattacatagaagagcgaaatgccggccacagattaaaccacatctgacaccaaacctttctcagagaaaaagctgagctgaggcagacaagtctgttaagaaatatgaaaacagagaggggctcatttatcccataaaagttggctaactgtgaaattcacaatgaattattagtgaaatggcaattggttaaattgttcagaaaaatattttcctaaaaacagaacaggcagtagatttttagaattttctagctacacactcagaaaagagaaatgaaaggatgtgctccttcaactcagtaatggaaagaagattagtataaacccgtgcaagccaatccaatgtgcatattgggctctctgtgacttcacttattttagatacctaagccctagtgtcactgttttacatggtatacaatgatctgggccaagccaattgcgttttgccttggaagacaaactctgatgttctattctggcttaaacctagtgaatgttctggagtcattttagaatgttcgcttctttgaacacatgaaaaagaagacttttaaatcctcctgaatcagtcccaatgacctgtcaggtctttcatcgtccaagatgggcaccaaggcctaaagaagaaaatagcatctcattttcgcattacggcatgcaggcaacttgctcaggaatgtgaattccacctaaacgtttgtttcatgttttatagaggacttaacactatatgaatccctgagtgtgtcgcacaaccaaaaatctaattctgttctatttgtcatcccctcaatataaattagtgattaaaaatgagaaataagctacaacacaacaaaccagatggtgtcttaccttcctataaacactgttgtgtttagagagtttacacatgtgggggaatgtaatgacttatttttttcacatttggcaatgagtcatgtcatccattttagcacaaactgtcctgaaacttcctcccaaatgaagacatggaacagtttcactaatatgtaaaagcacccatgccagctgcctttgattagtcatgatgcctctctgcccactctacagccctcatctaggagacaacctgatccagtcggacacccaaacagaaccaaaaggtcggcatgtcctgaagtcaacctgctggggaagcagatgcacttttggaggggccaagatgcttcttccctttgcttcccaacacatacccttaaaaattcaacccaggaacttgatttaacagtgtcctcctctttacttttgacactctccccaacctttctgagctatcctatggacctaacatatagaagagaaaccatgaataatctcaggaaagttctaagttcaccaattattaaaggagccagagtctatcccaactgccaacattcaatggatgtccactctgtggaactaaatgggaaggaaacaagaccagcctgaaatgcaaaccatgtttgacaaaactgtgtttcattattttacactgacagtgcttagggctatgcctgacacatggtaaacccctagcagggagttagccccgccccttctgcctaccccaacagtggaattgggtttatgtttccccttcatcatctgtcaagacaactcctcccctccctttgtggaattaacagtattaaactgactgctggtgttagtctgctttttggttttggtttgctaagccattgagatagtaacacctctcctcgtggtacctgtgaagtttatttatgaaactaaatccagatctctgtaattcttgctctttagattttatcttattggcttgacttcatcactgaagccattcatcctaacatccctgcctgctggctctctgaaatccaggtggccctgacatccccgtgtgatgttgttgcctctcctctgtgaccgtgacatgtgatgctggcttttctgtttctcccatcaccctccattgtttacttctctgtctcctggtcaagggcaggcatctgtcttagtcagctgacttcacattcccaaggccaggcctaagtaaatgagcatattcaagaacaacagtttggttggtgggaacgtaaattaattcaaccatttggaagacaggtggcgattcctcaaagacctagaggcagaaataccatttgacccagaaatttcattactgagtatatacccaaaggaatataaatcattctgttataaagatacatgtacccgtatgttcactgcagtactactcacaatagcaaagacatggaataaacataaatgcccatcagtgatagactagataaagaaaatgtggtacatgcacatcatggaatactatgcagccattaaaagggacgagatcatgtcctctgcagggacatggatgaggttggaagccattatcctcagcgaactaatgcagaaacagaaaaccaaacaccacatgttctcacttacaagtggtagctgaacaatgagaatgcatggatatatgggggggaacaacataccttgggacctgttgggagcatgggggagggagagcatcaggaagcatagctaatggatgctgggcttaatacctaggcgatgagatgacctgtgcaacaaaccaccatgacacatgtttacctctttaataaacctgcacatcctgcacatgtaccctggaacttaaaataaaagttgaaggaaaaaaaaaaagaacaacagtttgatgaacatttctcatttttatctcagaatgtgtgtaaatattaacaggggcatatccctaaagttagctttaacatcagtcaaaatcacccaaaaatgcaggggaaattaacccgggtggtacctggagatgacctaagcctcacccagatctagaagataccacacacacagaaggtgcctgggtaacgtttggcagatagcagcatgcaggaacccctttcttacaagttgctagagaaaactgcagcttcctcctccagaggctctaggcctaccttgatcccatctttcctcacaataaaattctcttttcaatcctccttaggaggttttctagtctcagaagaagccttcaatgctgttcataggagattaggtccccctgttttagataacaatggctgtccatcctgttcatgctcataaaagctcaactttgcacagacttccctgtgcaaacataccgatgtctcccctcttcctgtccattaagctgagtcccctataccaggatccttctacagacccccttggggcggctgtctccactgcccttgagaaccactctcagcctcagagacatttccagaggagaagggctgctcatgaacacagtcaagtggggagaacgaggccaacccggtggccaatagggaccaagaaggaaaatagcttccccttagaaatataaacattatctttgtaaatgtcatgcttatatggataatccacttagtaagctcacttttcatagatatcaggccagttgctaagtatacattgttccagtatctgaaattaatgatattcagtttaataggagtgttcctctatatagcaattctgcagtcattgattaaaacagtcctcacttttgctgtctggactcccattctccctccataatcataggcttcaggctccttcacccatccaatgacctgaaagcatctcccttgctgctgcctgtcacacctacacccctctccactcacccagctgtcccctctccccagtcagccacagagaaaagtttgaaggagctttcttctcactgcccagttttctattttacagaaggctttagaaaacacatatgtgctctggctaaaataaaagtgaagttataatgtgatctaccacatcaaaaaaaaaaaaaagaaacggaaaatagttttagttaattcagcatcagaaaatcaatatgtccttagcagcattctgtgcttgacttcaaaatgtgtgttttaatcttgactttattacatgttgtacttggttagctcacacttagaattctcatcaactgctttttaggtctgtggatgggaaggtactccataagagaaatcagcctaataattgaatacagagctttaaaaagaaaggcttgtataactctgaaggggacaaaacaatgacgcagaaataaagtcagactacagcagttcaaagacctgtccttgtttgtgattttttttctaatatacagactcaagggttcaactaagaggctgttgtcggttacgcttctcatctatatcctctctcagatcagcagacatctagccactctgctgcatgctaatataaaatctgtctctgtctcctcacacatcccgtcagagaaaccatctaatcatgaaccatcctatcattacagcagccactgtaaatgcttgggaaattaaacaacaaacaagactcctcattcaaatggaaagctggcagcattgttggggagatgacaaaacccatcattagactgggaacaaactgccttgccctatgtgccctttactgcttctctttttcagggtacgctggaagaaggggcatagctatccattattcactgacaatctcataagtcatgccactttcctaactattgtaaaagagccatagtcagaaaagtggggtgaaatgttggtgacagctgcttatctcaaaggcttctaaggtaaaccaccaaaccataatttgatgcaataatatggtggttattgctattccttgaccaactactcccaatcccttcaggttagatttctcctatttttacattctggagtacacagagttctttcaccagtagctaagaagatgcaaattgatcacaacctccctgaaataaaatgaggagggtaagaaatggcccaggtttcttgattctctctgctgtgaacctggggccatgtcaccttccccgtcttctttcctgcacggctgaggatggcagacagtaactctccttagcagacaaggcaatctacccagcatggaggaaacaacaagtaaggactgaagttctacccgagccacctggtagaagaggaggaaaaaaagatgaaggaaatctgaataattgaaaggcgttagccctacacttaatctgcctgatgttacataataaactctgtcagtagaaacagactcttcctttcacccacttccttcaccttttccaccagatttcttccatttgtcacccctacagctcagaattggccctgccctgtctcctaatgctgaggacagaccattaaaggaaggaaggtcagagaaattacaatgacatggctttgttccccaagaacattcactctggaagctgtcactgctcaaaagacatcttcattctagctcatatggccagagggagcccccttctcctcaattccaatttgctttgacagacacatggctgtgaagcagtggtttgcttcccggagctgaagctgcactggaattccaaagctgccctagccctgtcaacagaagtcagcagcttgaagaagaactgctatccagtcacagccagcgttccctgacacctgataatacacactctctcaggcaagatgcatcccacctcagattattccagccctgcctctaattgctcccaccagggcaaacagggtggcattctgctttggaaggaattattaaggctatgttgaaatgaaagtcaaggtgagcccccgcaaatacagctgcattttttaatccagaccaaacaaaactttcttttagcttctagccacactctcccaaaacaaaattttaaaagaaaaactgagatgcaggtctaaattatataataagaggaaccccagtttccctacccagtttgttactgaagaagctatttattacaaaagctccagagtcactgttctcctccaggtccatgcagaagcaatgaagcccaacgacaataatgccatcaggagggcaggcaaaaagctcgttttaaggctcccaacggggtctaatacatcatccaggaagaaggactactctgagaggtgcctcagagggaaaagcctgtcaaatgactcaatgccaccagactctgatctgccaccagaaatgctgcaaccaccacagatactcactgacatagacagaaaatcctgcttcattatcctaagtctaaacacgtactttatacctgtgggattaaaagtgcaaaaggagtcagatcagtctagatgttatttattttacatagtaattgagattcataaaagaaaaatacagttggacctcattatccagagattacatatttgcaaattcacctgttagctaaagtgtatttgcaacctcagaatcaaaacttgaggcacttcccagccattcatggacatgagcagtgaaaatttgagtctcctgacaacaggcattcccagccgaggtctgacaaggcaatcctatcaccttcttgtttcagctctcatactgaaaataagtgccacatcctctatttcgtgccacattttttgcactcttgtactttttgttggtgatttgtctgtttaaaatggccccaagcatagggctgcagaactggctggtattcctaagtgcaggaaggctgtgatgtgccctatgaagaaaatgcatgtgttagataagccttgttcaggcatcaattatagtgctattgaccatgagttcaatgttaatgaaccaattgcatattaaataagttgtttttaacaaaaaatgcacttgaaacaaggttatttattgatcagttgacaaaaatatggtgaccagaggctcgcaggaaccaaaccctatatttcccctaggagcagtggttcaggatttgctaattcagtatttgcagtgacttcatagagcataattaccacatgctctcaatgataagaagaaaagacgtaaaatatcaaaggacatgagcaacagatataacaccctaacagtcttccccagcctgacacaggatcatcacaggccaacctgaaggactgtgtaagtagagttttttcagttcactcagaagagtaatcagctccacagagggagatccaatggaagctacctactcactcctgaaagcaaagtactagccttcttgcttcaggggagcacagaacttatcttgctaactgaaagctgggagccactggtgcctgactgtctagcactagccaccctgggcggagacctttctgaagtcatcctggagtgaaaaatagactcctcagaaacacaaatctgtaccattgacaggcatcagggacgacaggctggtggccaaggtcacgtgctgaatggaggtaggaggctctggctgtgactcatgggactctttactgctctcattacataatgtgaaccagatcctcatcttctcatcagataatgatctttgttctccagactaaaggggtgattacaatctgaagagctgattgtgtctcattacacttgtgataatatattcctgatgaccaaggctaaccaaggctattaacttgaaccttcaaataccaacagtcacaagttgtccctttgatatattcgcatctgttctgtgttgaattgaaaaaggttttcttgctacaaaatgtgtaaaggagaaaaagttaaaccagtacagaacagccagtgctgtttttttccaatccaggaaagcatcttaattcaattgaatgacttttagtacactgagatcttaacgtaaaaacaaaacaaaacaaaaaagcaaagtgattcataaatgtcacagcataaaaaggtccaaagccctcactttattgcttcctgatagtcttaagcgcttctcctctagcaatgttttcctctgtattataatcttaagaactataaccactaccttttggaatggaattggtttccttttaaaccactttcctctctttatgacgaaaaggaaatttgagtatctttctctacctccatttctacattgtcagttgtcaaaagaaagtgaacaaaaataaaagaactagatgacatgtgttctcagattcagagatgtactaataaagggatacacgtactattttgcaaatcctagaagactaatttctatcatgatcacaaaaaatctaagttggtagtctccaaaaatggattcatgaagaaaatcagaataatttatgagtgacaaatcaaactcaagagttacaaataggattcaggtaccagaattttcattccaccagcataagatggggctttacctgaccctgtccctgtccctgaagctgagtgaactgcagactaacggcacctctgtctgagtttcctgctcagatagcatattgcagtttaatttattttattttattttatttatttattttttttttttttttgagacagaatctcactctgtcacccagactggagtgcagtggcctgatctctgctcactgtaatctccgcctcccaggttcacgccattctcctgccccagcctcccgagtagctgggactgcagtcactcgccaccatgcccagctaatttttttgtatttttagtagagacggggtttcaccatgttagcaaggacagtctcaatctcctgactttgtgatccgcccgcctcggcctcccaaagtgctgggattacaggcatgagccaccgcgcccagccgcatattgcagtttatttctagagaaagcatcaggactaggaagcagtatgtcaacatgaatgggccagaacagagaagggttttaaactgcaatcaagcaatcttatagtaagaaattgtgagaattatttaaaaatgactattccatttgacttttcagccaaaccaggctctaaaattcccccaatctctcagaatattagaagctaaaacaaggacgtgtgtataaataaattaactgagagctttaaaaagatctggtgacaacatgaaaggaaggcttacgacccactaaaattttgaactgaaaagcagagaaatggttgttatttgactaaaacttacagaagacccttcttcttcggggaagcaggagtgagtcagcaggggacacattatggagaatctcaaatgcacaaagcactgagaggagaaagggatgaaaagaatttcaggacaatccagaggaggtgcttaaaaagaatcaagtctctgccaaagacagaaagagccagctctttgtttcagagaggcctgcagctacaggacttagattggggcataaattctaattaaagcaaatctttctagattccctgaagaatttccactcaccagcttcatctgtcagtgtggcttgagccacttgctacacagctcgacccagagctgctctgtccctggccatgccaaggaggaaactgtgtgtggtagccacactctccctacctgggaggtttatcctcttctgcaactggctgcttctgtaaagacaagcgtctgggtgcagatgagcaccaggatttgaccaaggaagaggaaggaggttaggaagcagagaacaaaacacaacaaaacaagaaaattaaaaactctaaccttcaagggatttcaaggagaaaacagaggaaaaaggacaagtagaaaaaaaggaaggcttctttgagcaggcagagcacaattaaggacacctgtgattttaggagctaacaaaaagcagatgtgtcatggcctcagactcccgtcccttcagcccagtcctcatgcagcctaactggaccccaaaccacaaaggggctggaggagaaaagggaggtctaagtcagcccagctgcaataacaaaggcagaaggctggaaccacaaaagcttttaaaaataaacattgtgattcaaggcaaggggggaaaaacagcactgagggaaacttcaagaagcactggctctcagcagacatcattttaaagaaccatttggaaattgccattcaatgaggtgtttaaatgacaacagagaggctgtcttacccaagtagaacaggatcaaacagagagatcagaagtaccctgccctgctcgcacttttctacagagcaactaaacttgcctttcatctctccaggaatactttctccatcatgaacgtaactaaagcctctaagacattgaaagatctggaattttcatactgttataccccctacacattctagatcgagcctagcaaattagcccaaatatgtatctatttcagagcttttaggaaaatagctagtctccctgtttgtactaaccacgtgctgcttctaaattcaatgtctgaatgtgcaaactatggcctagaacttcctaagatacttaaaagaaagaggaaacgtggtaaacctacaacacgcaaactctccttgaagaggacttctcaaaagctcctcagaggagtagaaatcgcaccatgatctaagttcaaaccctgtcaccaatttctacctgtgcagagtggatatgtatttctgttgttttttgttttgtaaaacttctctcagtttcttcttctgtaaaagagaggtaacagcaaccaggttgcaagtaaatgttgaggttccaacaatatgcataccaagttcctcactcaaaattgctcttaacccttcaatattattatcatcataacaaacaaatatttctgacaccaaagggctgatggttaagagtgttggaatggtctactctacgagcctgcatccatgactttacccatctgtgcctccttgcttaatataaaaaataaggtatgttagattaatttctttaaggcccatttgaggactaacaagtctagttgtctgggaatttgaattcttcctctgtattttacaactgtaaggattcatcctattgctattaggaaggtttttttcctccaaacaacttttcaaaaaaagaaaaattaaatacattaatttgatgccttttggggctacatgttttgaaagggtcacaggataagattttgatatgaggtacaaaaggaaagaaaaataattcttgaaaaaccagcatctctcctttttttttttttttttttttttttgagacagagtctcgctctgtcacccaggatggagtgcagtggcgccatctcggctcactgcaagctccgcctcccgggttcatgccattctcctgcctcagcctccccagtagctgggactacagccacccgccaacacgcccagctaattttttgtatttttagtagagacgggatctcaccgttttagccaggatggtctcgatctcctgacctcgtgatccgcccgcctcggcctcccaaagtgctgggattacaggcgtgagccaccgcgcctggcccagcatctctccttttatttaaggatgagacaaagccattatgtatcacaattgtgtaaaggcacaaagagctaatgacaaagggccttctttgttccctagtcatagcagttttgttctaaatcatcaagtctgctacctcctaaaaattgatctgatgaatctttcgctctttctcaagcttttgaaataatgtagaacccataaaccctaaactaagatgaacatttgccaatgacactccttcatcaaactttaagctgctcctcctcataagcacatcagcaacaaggcagttaaggtgattcagatagcaggcactcgcccatacgccacccagcacgccaaggcagcttttggtcagattgcccagcaagccacacaagatggtggcaaactgctctggggctgtgggagagagccaaacacagaagctccaagggtgagggagggaagactctacagaaaaccagggctccatgttcaaagctgagtttgctgtaaaatggagcacaggaaccctgaattgccatgaataacagtgccagctcctcggaacacgtatgagcatcaatttgggaggaacccaatgacaaacgacagatacaagtagttgagaggctcctaggcagggagtcccaacgatgtgcacattttacaatcagatttgtatcaaaggcatcctttaatgcccccagggacaactttcagcttcagttagaataaggtaagctgtgttgtaggaaaactgattcaagtagtcttggaagactcagccaataatttgatctattttcacaagaaaatatgaaccagaatgatttttatcaatgccagtggcaataaatagtgtacataatatgctatacgtagtatataaggttaatagctaatatcaaatctcaactttttaaaaaaagtcccataattacactattttctttaaaaattagaactgtttcctggaaagcctttgagggatcgtaatttaaacagattttaaggcagctaccctgatacctgcttcctcctgttcacactcctgcatgatcccttgagggtaggtgggacctgtgacttgtttctacaaatagaacacagcaaagataatatatatgcatgattaggtcgttatattatataaaattgcagcacccatcttggcagcttccctttctccctggctggcttttggattcaaacagcaatgctggagaaatccatacgacaaggaagtgcaggcagcctctagagctgaaaaagcctccagcaagaaaatgaggccctcagtcctacaaccacaaggaaacaaattctgcctacagcccaagtgaaccctgaagcagatccttccccagctgagcattcagatgagatccaagccccagtcaactgtccttgattgcagcctcggagaaaactgaacaaagccagatctagactcccaatccatagaaatgatgacataatataatgtatgttcttttaagtcactaagtttgttgtaatatttttatgagttaatattagtagataactgataaagatcattaaatctcaagttgttaaatacagagaaagataaataattttatttaaaataaatctatatgattgtttattcaatggaactggtctataataaaatataaatgtatattttaaatgcctgattttattaagcttctttttaattacagcacaaaatcaggcattgcagataactgattccttttccatttacaattctgcagtggttctaaagaaagcaaggtcataatcaaataagagaaataaaataacatcaaaatatcagcatttgatcattagttaccatggagagttcagcttttaaattgacctacaatgattagacagtgccacatcatctactgtcaagatttgttttcaaatttttggtagctcatataaaacacctctgagaatactcagtaggagatttttattctgattttatcaataatacaaatgaagaatctgattgttgaccaggcatcagtaaagtactgtattactaaattgtgtaatgataggagttcatgggttagaacaactgtcagtgagttcacagaaatacatttaatattgtcataaatatagactttaaaaatacgtagaacaaaacagttttaacaaaacagaaaatattcaagaaaagatgcaagtctatttcaacagattaagtatatacccaaaacatgaaacagcctatgcagatactaaagtatttttaaaatcatatttatgaattaatttaaacataattagtataagtatattatttcaatctgtctactattaaagattaaaaaagtaataaaatataatatgctagatgttcaagtagcaaaatctactcactcgaagcaaaacgattttgattacttctctactttttgggaaaacagagaaaaatgattttcagtcttgaaatgtttattaacttgaaactgaaagaaacattccaatttccatttttgaactcccagatattaagggattgctatcttctaaaattaattatccttttaatgatagtatatgacacaatcaaatgaaattatttgctatattaaagccatgtattcccttactaagaagcacctatgataacctatgtcattatgttttgaaatttttcagcttatttattaccttaagacttaaatgtagttaagcaagtatctattttgttatttttatgaagagtaagctgacaatttttccctcaatttgctatcttagatttccctaaaccttgcttagcaagtactctatcacttctcttggtcttaactccaaagatggatgagaaaacttgagtatagacaggctcactgtaatttacatcattcatggaaacgcctctttccttggtcgttggcttttctcaaacatacacttagcatagagatttcctagcatggaaatgatggttaaaagctcatgtgtgaagatcagctaggaaactattgtggcaaagcaggaatatggaaaagctgaataccaggtattatttcagatttggttttgttctcctcaaggtgtcttacagagaatgctcactgaatcttccagggtatcttaaaggcatggaagattataacttaggaaaaagcaaatataatgaccaagagctgacaccaaatggaaatgcttacagcaatagcagtcagctgcctgaaaacctcagcttgcccctgttattactaatggcccaggtaaggcaaagtccttagttagaaactgaaaaatcaattattggctgccaagtactggttgacctgacaatagaatggcatagagaatgatatttttccaagtagaggcccatcatcttctgattttttacagtagaatcaaatgtggggtcaggaacacctgctcagaaacaccaccgtgatatcactccagcacaccttgctacctctcttccctgaaggatgcatctgtaagaagcggtgtaattagagatacttcactgcacaatcatatgtggaggaaacagcaatagtatagtcctgcagagacaactaagtaagagacaggcaacgattcttttatttaaaaaactatgagtatagtctaaatagtttggtgtgtttgcacatatgtatgaacgtactccacagatgcttggcatttatcattctgttacctaggaggggacttccactctgtcctataatctccaagttagcctttctagccagaaaaaatcagggatcaaagagacactgaaactgtggcaacataaaaggcagaaacacaaatgtcttgatcattggcctacatccattgttaggatggtggcactgctatctacaaccttggcttaaagacttcaatcccaagactttctcatactcgagttctagaagtatctctatcccaaacctaaacaaaatgttcaccaagtcttccccaaaattgcctcttacatgagcacactttttaaaagaagacatacacgcagccaaaaagcacatgagaaagatctcaacatcactgatcgttgaagaaatgcaaaccaaaaccacaatgagataccacctcacaccactcagaatggctattattaaaaagtcaaaaaataacagatgctggcgtggttacagagaaaaccaatgcttagacactgttggtgggagtgtaaattagttcagccattgtggaaagcagtgtggtgattccccaaatagctaaaaacagaattaccattcaactcagcaatcccattaattgatacacatacccaaaggaatatatatcattctaccataaagacacacgtgtgtgtatgttcattgcagcactattcacaatagcaaagacatggaatcaacctaaatgcccagcaattttagactggataaagaaaatgtggtagatatatagcatggaatactatgcagccattaaaaaaatcaagatcatgtcctttgcaggaacatggatggagctggaggccattatccttagcaaaccaacacaggaatagaaaaccaaataccgcattttctcacttataagtgggagctaaatagtgagaacacatggacacaaagagaagaataacagatactggggcctatcagagggtgcagagggaaaggagacaggggatctgaaaaaataactaaggagtactaggcttaatacctgggcaatgaaataatctgtacaatgaacccccgtgacataagtttacctatataacaaacccgcacatgtatccctgaacttaaaataaaagttaaaaaaaaaaaaaaagaattttcaagaactccctgggacatgaacaataaaaatgccttttgtggatgcttaaaaaaagaaaaaagaaaagaacaataaggatgcaacttgcatccaagctctgataaaagactcatcttgtgggaaaccatcttaatttatgttgagcaagaaagtcttattggggaaccacctagtctgaagaaaaacagtgaaagcgttctcaagtgcgaagtatggattctgacaacgaattctaaataaaagatcattgaaacaactaaagggagagagggaggttttgtgataaactgcatttgacagagttcctttagatctagaaaaaacaaaaccctccatacacttatggtatctcctaaatattaaagtcttctcgagggaagggcaggaggtcaggacaatatcatgaacaattaagtattattttccaggcaagttagttttttttttatttttctaaactgtcagtggcaatcattctctaaagaaaaggggcctttattctgagcctgagtaaacatagtgaagttgctatagaaataaagaagccaaaatctaaaccataaaaaaactctggtgctaaaaatggatactctcattttgctgcaaaattataggttcagcaggtgctccaagccactgagacctctgctgccaacgtggggctttcctctgtccctaagcagctcactgtcttccaaggaatctaagtcatagaaatggcaaggtgtattgaatattctggtagtagatgctagaccaccaaagttgtttcaaatcaacagctgtaaccatcagacttagcctggaatgtgttctcatctggctctgttgaaaaagtactccacacccccctgaaggtgttttcactgtgtctgcgttgtggctttgggggaacattatctatgttgttactggttgataagctacactctaaaggcgaaatccaaaggagtcttttcaaatctgtgatgctgtattcagattttctaaacctcgacactgttgacatctggggccagataatcctctgtcatgggggagctggtctgtgcatggtgagatcctgagcagcgttcctggtctctacccacaagacaccagcagcagctctccccaccctgaatgacaacaccaaaaatatcattagacattgccaaatgtcccctaggaaacaaagttgcccctgattaaaagccactgtgttagatccatttaatagtataactttcaaatgaggccttgaaaagtatagggtaaatctatttgcttccctatttggaagataaatagttacaggaaaaaaacaggagccagaataatgtctaaactcccatgtcttactaagagtatgcatacatacacacgtttccatcggcttagaaaatttctggaaagaactgttaagaagatgttaatagtgcttgcctctggagagtgaactgtttacactttcctactgtttgaacagtttactcacgtaccccttttcaatcatgttttaaataattttaataacatatttttaagtcacattcaatatattttttagaaagcaataggtgttgattttcagtcaaattagagttaaaatggggttttccaatccatttgaaattccaaagcccccgttgagggagctgggccccaggcttggatgccatctgccggcagcagccccagccctggcatggaagcttgtagaccatcacagcctcctttgagtggaaaacagaataaaatggaagaaagtgccacaaaagcccacaaaggattgctcgctgtgtggtcatcgttctctggaataagatccttagtcctaaagcactcaggtctcttttggagcagatgccagtggcaagtctcacagcggtctgcaggcaccatgaagggaggtctgagttttctgtccagcacgatggtctgcaagcgtgtgcggacctgtggctcgtgtttcctagtaatccccaaaaatgcttccttgaaatgcttctttaaggagccccaactacagtcacctggaacgagctgtaaaactgtgtaacatgaggtcatttcattctggattctggatcctggatccccaacagaatcaataagaaaatgtcaaaatgctgggccccaggcccgctcctgacttgctgaatcaggacctctgggtatgggaacacagtctcattgttaacatgttaccagatgatccctgtgaaactttctgcttatctgtgggtcagtattcaagagtttccgtaattttcaagttgaaataagaatcttatgtaaaatatagtgactttcccaagggctgaaacttgcagattttcccaaaagagactccatgtctcaatcttgaaatggttgggagaaatttatgcatcaaaaaggagcattttaaagacttatcgtgtgccaagatatattaatacagtcagccctccatatccattggttccatatctgtggattcaacaatcagggatggaaagtaattgggataaagaaattccacaagtgctgtaaggcaaaacttgaatctactgtgtgccaaatactatgttgaatccaagcaaatgaaatgatgtataggcattacataggatactacaagtaatccagagatcatttaaagtatatgggaagatgctcacaggttatatggtaacactacaccattttctgtcagagacttgagcatccacagagtttggtatccacaggttcttggaaccaatcccccatggatacagaggatgactttattctccatctatattccactgggctgactgccatgtagttatttcattactttttactgttttgggtccttgggaaaaacaacatgtcatgcccagaatgataaggtgatatctgaacaggttccccaaacacaaagacgagcatgcatggcactgaagtgagagagtgagaagagaacttcagagagacgtccagtgttgctaaccacagaggacccagtggagaattcagagagaaattacaagttaaaccaatgctaattattgaccaagaaggccttaacatttctttctctcgagggtaatgtcaagccagcaaggtctgagagttgggggtgcaagtatctgagtagctgtgcacacagatacctgggtaccaatgtggagatcactgggaaacaggattaaatcagtaggaataagaaaagtccccaggcacaccggggactgttgtggggtgaggggaagggggagggatagcattaggagatatacctaatgctaaatgacgagttactgggtgcagcacaccaacatggcacatgtatacatatgtaacaaacctgcacgttgtgcacatgtaccctaaaactcaaagtataataataataaaatttaaaaaaaaaaaaaaaagaaaagtccccaggcagtgaaggaatcatgcctcacactatcaacatggttgaagaggatgggaaagaagggctattgaagggctactgagcagtgaagttatttatgagatagaattttgtggctattagagagggggtttgaaaaacaaaagggtaaaacttagaatgattctgagatttctagtttgggaaactagattcgtgtatttacagacaaagataaggaaatccaattaccaaaaagtcattaaatgaatacaatctgctcttacattactataaagttattattttccatgtttatcataaatatttcagagctaattatctgggcttggtttcacttgtgtacttggctgatttttctcattcctcctcttcccactcagcattaaataattgggatccactcccaatgagtgtttctgaaatactcttcaaagtcattgccaagggagagattgccttttcggattggtgtgtctcagatttatcacaagagtgggcagatgtgagggaaaaggagaatgagctttggcagtaacaatgcagagaagagttttgttattcttagtgagcatcaaaaggcagaaaggcatcctcataaatcattgtccaaaccaatagccttccccagaaacaaagttttggcccttctcatcttttgagctaaaagaatcagatgccaagaacagggagatgagatgcatgaattgttctttttttttttgagacggagtctcgctctgttgcccaggctggagtgcagtggtgtgatcttggctcactacaacctccacctcctgggttcaagcaattctcctgcctcagcctcctgaatagctgggattacaggcatcaaccactgtgcctggctaatttttgtatttttagtagggaacggggtttcaccatcttggccaggcttgtcttgaactgttgacctcatgatccacccgcctcagcctcccaaagtgctgggattacaaacgtgagccaccgcgcccggctgcatgaactgttctgaggcctgatgagcctttgcttattcccagattagaactccaggcaccttccacttccatgggtgagaacttcagggtatttactggaggactccaaacttctgtttgtccatgccatgttgaggaacacctcagctggccaagtgggtatacctggaaaaagctctttgtttcctggcacagactagaggactgtaagcatgggtggctttccaactggacagaatctggtaaacaagcaccaggagcctctaagccaggatcaagctgaggcaggtagcagcagctctgtgcctggaggtgggagccggggtgggtggaaggtctaggcaggcctaagcccgccctggcccagcgtgggtctggcgtcctgcctgcgggaggctggttccttgtgcagaattactaaatgctacaaataaggaaacactgcagatgaaagttttaaaggtttattagtaataacaccattcggggcactaaaacttcaaagtcctttgactagcagagtctaactaatctttacaacaccccagtgggctaggtaagcaaataaatattattatccctattatgtggagcacagagagctgtaagaggacttgctcagggctacaggaagatcagcgttactcacatcttggtaactaccaagtccagactcagaacagcaggctgccccttactccactgactcatgctgccacaaaaacggcagggagggcccgggaaagagactctcatgattcagaacagaacttgtgacagaagcaggcattgttggtttttttcttgttgcagctttaataacagtaaatgacagtaattttgcccaattagaaatgtctgacttgagatgttaggcagacgccttcattactggaacgtctactgtaggattttgacaaatcttacccagagtgggaccagcttccctagggctcctcctgaatggtgactcctacatactaaggctttccaggttaacctaaaaagtgtaggtttgcgaactaaacagtccttagtgggggttttaatccttcttttaataaattacaatatgtttctaaataaagaaattttagaaaatatgaaatggtaaaaagaaaatggtagtatgtgaactcttcctagtactataagtgatttctggtaacacttgggggtgtgtcctacatttaaactatataaaattcaggctgtctatatttcttcaaatccttgaataccatccaaaaatctgatttaaatggctacatagcaacccgtcaaatggtggcatccatttactcggccaatctccagctacatgatagtttggggtttcgaattactagtatcacaacaccagataaacatcccttttcatgaatatttctattaatttcaaaattttagaagaagagccactgagtaaatggattcatacatatttaaagcatttcatacctaccgtcacattgttctccataatattctatcactttccactttcgtatgttgtaagaggttcatttttctgagcctccaaaatttctatgttggtgaggcttaagagtagcaatggatttttttgttttgttttgttttgttttgtttttgagatgaagtctctctctgtcgcccagactggagagcagtggcacaatctcggctcactgcaacctccgcctcccagattcaagcgattctcctgcctcagcctcctgagtagctgggactacaggcgcccgccaccactcctggctaatctttgtatttttagtagagatggggtttcaccgtattgttcaggctggtcttgaactcctgaccttgtgatccacctgcctcggcctcccaaagtgctgggattacaggcatgagccaccacacccggccagcaatggattttaattaatagctagtgaatttagcataaggtcatgcttaaagcctagattttagttatgcggaatgtttaattggggtagtgagagagggctaccagaaaacagagaaaggtaatgtttacccatctccaaaatagccaccaccttctattaagcaaccataaaaacaactcatgtacaagatttttgcaagcaaggtgtccccatttcacatttgagaaaaatgaggctcaaaaagattcactcactcgctccaggtcattgatcctaggtttggagccaggataccggccctagggcatctgttccatcccactgggatatcaatggaaactaaaagtgctggagaccctgagcagggtagacaagagaatgtttttgttcatgattttttttaatcttcttcttccaaattataaatggcagaaatgtttttgatgctagcttcaaggcaaccttcagcatgcaagaacccccagcaggcttgcattaaaagcattttgtaagaaccttgggtatttggagtacttttacttaaatcttgaggaacacatgtttaagagggcaagctctgagccagacaaatgtggcttttattcctgagtctgcaatttaggatgtgtacaactttgagcaggccccaaatggaaaatccaatcttcatttgtgaaatgaaaaagagggggaattaaaagagacagtacatgcagaagggtaattccaacgtctggacatggtaagtcctcaagaaatggcagcttttaagatgagcatgttagggggggttccactatttcaaacaaggtcacaaagaggtagcataggtttttgacttacaaggagagagaaggtaatctcaactccacaggctggaaactctattcccttgatgttagggtgtgtccccaggttgcacaaagaagtttcagaagtgggaaattccttgttcctatagtgtgtgcttcaaacaaattatgcagcaatactgtacaatgactgagatttggctctggggaaataaacaaaattagattccacaaccaactctgtccaggaagtaccactgcctcttgagtccttaccttcagtaagctccatatgtaaaataaagatcattgaatttccagctcatgtgagaagtgactgagacaacatgacatatgcaaaggtaagggtaacaatgtctatcacataaaacaaaaaactcatacaggaattacagtatccatgagcgctgtccagtcttcctcccacttcttcacctcttcaaagttggccatagtcccaggatttctctggccaatgagatgtaaatagaaggaaaccatgcctcctctggatgaaagccttcccagggtcaatggaccatatgccatgttctcttatttccctaacagtgaccagcaactctcaagatgacagccaccccagaaatcagcctgcctcccaaagacagacctcttcaaagagcacctccagcaagcccagatgcacatggagcacaaatgagaaatgaacatttgttgtttgaagctgcagagatttaggggttgttggttacagcaacctggcccatagaaactgatgcagattttaatatgagtagcttattagtccattccatagagctggaaaaagcgatcctagttattttttatcaaaacattaataataattatgataaggagggctttctcaagtagagtaggtagctgaaaagaaaaacaatgtaatgttgaagacgaaaccctcattcaggaccctctgagaactgactctgctttctgccttggaaaaggtcagggctcactgacatagagtctaatttaggaaccaggagaacccaattcccttcacatccgtatatcacacacctaagtctacaagaacggtaatatgagtgtcctgaggatgaacgagtgatggggtctcaacatgttggggctgatgtctcagttcctacaggacccttcttgggagtgtccctgaaatactgcctaactgggtatctgaagaggaacgaggcaaaggaaagctgcccagagatagcctaaaattgccttccagaggtttctgtattctaattgtattctgtattctaattctctaattgagtgagttaattagagagagaatggtgtggcccttcctaccaatacataatccaccagaaagactggaagtttttcagtaccagcataagtaaggataggaatgcttgatttaagactagaaataacttacgacaattaaaaaaacatttttagcaaagtaacccgtccgattagaaactggtttgttagaaacagtagcaaagagagtttttaaatatccaaactatgcatcctaaataagtttataagtcaatgtttgttaagttgagtaactgttgctattaacaatctttgcaaccaataagtctgcatgtaccccttttaacaagattcattaaatacctagctaaacgatacagctaaacgatacaagcaaactcattgttcaaatttaaatgcaaactcattgctcaaaattaaatgctctgtggtatgcttttattcccaatttttcttgaaggaagaatgcagaaaagtagaaaaagtaacaacctgctcctcttagaaaaatgattgaatgctttatacagtgtaagatctataatgcaaattattaagaatctggctacatttttttattatactttaagttttagggtacatgtgcacaacgtgcaggtttgttacatatgtatacatgtgccatgttggtgtgctgcacccattaactcttcatttaacattagaaaaaagctattgactattgactcattgcttctatctctcaaatacacacaaccaatcatgttttctgacagcatgcatcctctgggaaatatttcctccacctcttctctaaaacttggcagtgtgaggttttgctttgcctttggtttttcttctatctgcctcatgacacttttgagcataagaaagacatcatctagtgccctggaagatgctttgttttgattcttgttcttttatggcaccctctgatagcattacctgactttggaaatcaattctgtgctgtgagaataaggtttgaaatgaaaacttcctgccttgtgttgaaaggacagagttagttttattgaggctagaaagtatttttccctgtattgttctatagacacagaaacaatccttagctcagtctggggcaaaagccaaagaaattgtctaaaatggcagatcctgaaggaggcttgggggttgggaggtgatgaggaagcagtcaagaaaactgtataataataattttgttcacttccagatagtctcctaatgttttcatagatctacttttcttcattgtgcaagctgcatatgtccactgtaaaagttttagaaaaatgtaataaaagaaagggaaaaaagcattcactatctgagtatctacagataatcatcactatcattttgatgcatttctttctaatctttattcaaaattattagaagtatatataaaaatatataaaatacatatacttatatagaattagtatttattgaataagttatgtataggatatatttctctgcatataaagtgaaatcctttaaaagcagaattttaacaactgcataatattcatgtcatgtacgtagcattattcatttcatcatttccttaccggtggccatttctttgccccatattttaagttgttcattcttttttctgtattttgtttatttacatatgtaccctaaaacttaaagtataataataacaaaataaaatatatatatatatatataatgcccacaaaataaaggaactaagtcataaatatgcatatgatttacataaaggagctaaaataagaaaaaaaaaaagaatgataaaagtcagcagggaaaagaactaccaaatcacctagtcaagtaaatgatttacaataacaaaaacaaacttaaaaactctacttgtaacaattttactggtgactaatacttctttaattaataaaacctattggctgcatatggcaatcagtggtaaaaaaaaaaaaaaaaaaaaagactaccaaccaaccaataagcccatgtagaccctggttctgtgaccctggttctgactctccaggaacagccaccggggatcaggctaccaagacgaaggcagagagcaggcagggtatgtagattttaccccaaaattcaggccaaacctagggctcaatatattcactggggagaggaataaggaaggagagagaggaggaaagaaggagggaaggagctgaagaggaggggctggggaggagtaaaggagaagagaaagaaacaggctcagggatatgggcttagggaacgtggtgtgcatggccatgggtggactggcagaagggcttctggaaaaactcagccctgtaaactggcagagaagggcacacatgcatcagcacgaggataccaggcatgaatatccaagtgctgcagaagccatgtgttctcatgagctggagggaggggagcagatgagcagcacagcagtccaaatgctgaaagagcagagctgtgaatcagtgatcaaaagacagggtgaccacatggagtccaaagatgctggtgagaagcaagatcatacaacagataggaatggaatgcccactccacaacatatggggcatgtaagatacatcatggacgtctacccacaaaaagcgatgtcaaatgagttttttttaaatattagaaagacggtgaagagtataataaaggaggggctaataaaaggcaaggatgctgacagaaagaagtcctctccaaggtgaagaattccgtccgtcagagctgatgatcagattgatcagtgagagaaaggatcttacgtggagtccgagcatcccaaagaaggccactcccgtacacccagctgaggccaggtgcaaatgtgatgtgtggggtgggggtgtgcctgaagccaaggctaacccaaaacatctgctggcttaaagggattctgggggagggctcagacacacatggggaaaccagctgtgagaggcatgaatcaaagaacagagccttcccaccaggaaacaggagtctggcttgaaaaagacgcaagagtaaataggcacatgtgagaagcatgcttaaaaaaaaaaaaatagggcattctggtatttcatctgaaagagtctacacatgttttaaagatttatccattcactaagaaattgcaagagaaacacccaccacgtgcaaggcacagcggcatgcatctttttctagctcaaagtgaattgaatgtgcccgtgattgcagaatcatttccattgtcagagtagaaatggctgcttccactctgtatggtggtaactcagtgaaacttactgccacctacatggccccatgtcatccagctctacccacctctcctgcctcaccccctcgcccgagacactctggccataccagcttacaccagccaaccctcaagggacattggtttctgaaacaggtgagccttttcctgcctctgggacttcacgtgttggaacccacctccattcttgtacttttggttccttcttattcttcatgtttgcttttatttacttatttatttagaaaccgagcctcactgtcacccaggctggagtgcagtggcacgatctcagctcactgcaacctccaccttccaggttcaagtgattgtcctgcctcagcctcccgactagctggggttatagacatgcaccacctactttcgtatttttaggagagactgagtttcgccatgttggccaggctggtctcgaactcctgacctcaggtgatctgcccgccttggcctcccaaagtgctgggattacaggtgtgagccaccacacctgctctacatctgcttttaaatgtcatggcctcacagaggcctttgtggtccaccgtgtcaaaatcttcaccatgcctattctcccatcaccctcatctcaagtttaattatgtaccacagtctttgttttcttatttgttgtctattgccttggttagattttccaaagaaaggaccgtgtccttcttagtcatgggtgtctgtcaagtagtggaggctctgtgaatacattctctaattttgagcaggtcaaagcaggacaaacacagaatgtttaatgaaaaggcagcctttaaagtaacatttattttccatttcataaaagttttcaaatgattttacaaatatgcaagaaaaattcatctgcataatacctagtggcattatctatattataacctaattgtcctgagcaacaaagtaactaaggaccccaaaatgaaaaataaagttgatttagccagttggtattgttaaaagtttgactggaagctactctatagcaggaaaaaagagtctcattcatatttgtattatcagtgccaagcaaagaacctggcaattaataagtgctccattaatgtgattttgattaaaagtgttcacgttttaaactaacatatggcagttatctttaaaactatagaatgacacaggtggaaagaaaatctcccttccattcccaaacttcaactcattttacagaggtagctaatgagaaaaagtcaatgtatattcttcgaaacatatccatgcattaatgatcaaaaatacctatgcaaggagatattaggctatacatgctgtttaacacctttcttcattcacccttcattcacatataatagatatttccatgtttgcaaaaatagatacatcattctatgtaaaggccgtacattactctgtgctttatttaaccaggtcacttctgtggacatttaaggttttttccacgattaaaaataaaaaaagcaatgaacatctacaattgtgtaattaggtggacataaatacaagataaatccccagaagtggaagcatcagatcaattaatgttgatagaaatttcctaaagcaccaaacagctattatagttacatcaacccttgcacatgttgggggtttactttttttttttaatctttaccaagctaataggtgaaaaatagttgatagtttacatttctttcattctgagtgaagctgaacagcttttcatactgttagctgcctttttggtttcttgataaaagctaaaggagactgatgcctccatgccaggtaccaggagggttatggcaagagcaacaaccctctgaagacaggctggatggagtcatgattcccatccacacagagctcaaaccaccctgggctctgaatctccagcccaattgcctaacgcatctctcaccttacccacacttctgcacactatgccttattattttttaaatgcctattcttcatttcaggtgacatacttttccatcatctttaccacaacatctactaaggcaaaataaaaatacccattgccattagaaaacagcagaactgtaccagatttggtggctcatatctgtcatcccagcagtttgggaggccaaggtaagaggacacatcacctgcggccaggaatttgagactagcctaggcaacatagcaagaccatgtctttacaaaactaaaaaaaaaaaaatagccatgcatggtaatatgatttggctctgtatccctgcccaaatctcatctcgaagtttaatccccatatatcaagggagggaggaacctggtaggagatgattggatcctgggaacagtttccccatgctgttctcatgatataatgatttaaaagtgtgattctttctccttctcattctctctctctctctctctcaccaccatgtaagacgtgcctcttttccccttcatcttctgctgtgactgtaagtttcatgaggcctcaccagccatgcagaactgtgagtaaattaaatctcttttctttataaattaccaaatgtcagatagttctttatagcagtgaaaacaggaatgtaatgtaatacaggaaatcagtaccagaagtgggacattgctataaatgtacctaaaaatgtggaagcaacctttgaactgcgtaatgggcagaggttggaatagtctggagggctcagaagacaggaagatgggggaaagtttggaacttcctagagacttgttgaatgattttgaccaaaatgctgatagtgatgttgataatcaagtccaggctgaggtgctctcagatggagatgaggaacttattaggaattggagcaaaggtcactcttgctatgctttagcaaagagactggtggcattgtgcccctgctctagggacctggggaactttgaactcgagagagatgatttagggtatctgtcagaagaaagttctaagcaacaaattactcaagatgtgacctgggtgctcctaacagcatatagtcatatgtgttcacaaagagatgatctaaaattggaacttatatttaaaagggaagcagaacataaaagattggaaaatttgcagtctgaccatgcagtagaaaagaaaaaaacatttcatagggagaaattcaagccagctgcagaaatttgcataagcaacaatggggaaaacgtctccaaggcatttcaaagatctacatggcaggccctcctatcacaggcctggaggcccatgagggaccttcctgggcccagggtccctgtgctctgtgcagccttgggacatgatgcgctgtatcccagccactccagctacagacatgactataggggccaaggtacagcttgggctattgcttcagaaggtagcttccttctgccaagaagacttggcagcttccacgtggtgttcagccttcaggtgcacagaaaacaagagttgagctttgagaacctccgcatgtatttcagaggatgtatggaaacacctggatgtcgaggcataagtcagctgcaggggcagagccctcatggagaacctctactcaggcaatgcagaggggcagtgtggggttggaggccccatacagaatccccgctgggcattgcctagtagagctgtgagaagagggccaccattctccagaccccagaatggtagatccaatgacagcttgcactgtgcacctggaaaagctgcaagaactcaatgtcagctggtgaatgcagctacaggggctgtaccctgcagaaccacagggtcaaggctgcccaagggcttgagagtccaccccttgcatcagtgtgccctggatgtgagacatggagtcaaaggagattattttggagctttaagatttaatggctttccttctcagttttggacttgcatgggccctgtagcccttggttttggccaagttctcccttttggaatgggagcatttactcgatgcctgtactcccattgtatcttggaagtaactaaattgcttttgattttacaggctcataggtggaagagacttcccttgtctcaaatgagactttggacttatacttttgagttaatactggaatgagttaagactttgaggagaggcataattgtgttttgaaaagtgagaaagacatgagatttaggaggggccagggtgggatgatatggcttggctctgtgtccccacccaaatctcatctcgaattgtaatccccacatgttgagggaggaacctggtgagagggattgaatcattggggtagtttcccccattgtattctcatgatagtgagttctcacaagatctgatggcataagtgtggcatttgtctctctttcctgccacctacatgtacgacgtgcctcacttccccttcaccttccaccatgattgtaaatttcctgagtccccctccagccattcagaactgtgagccaagtaaatctcttttatttatcaattacccagtctcagatagtttttttaatagcagtatgaaaacagactaatctacatggtgacacatggctgtattagtctagctactcaggaggctgaagcaggaggatcacttgagcctaggagtttgaggtcagtgagctatgattgtgctatggcacttcagcctgggtaacctagtgtgaccatgtctatgaaaaaaaaaaaaacttaataaagaaaaaagcagaacctttctacaataagcgatggcgggatagtgggcaaagcaaagccttggacgtgggctctgcagcttataagtgttccatctggagtgtcggagcgtcagcttcctcatctgtaacatctaccctgtaggaatgttgtgtgggtagaaagaatgtatgtacagtgccctggacttaatacaatccagaaacggaagtggttattattggcaacatgatgtgggtaagatttgtggtaaggaataaaatcttcttcgggtattaattctcccttcataccaggatttcagaacaagggaaatctttgctatttccccatcaagaatcatgtatacaacctgttcgctggagaggcaccttgggctggcaggtactccggagatggccactccctcactagcatcaccagagggtgatgataagagaaggctacagggagaggaggttgatgatcacacacatcacctctaaggtggtggaggtaattcatcagtataacaggcactcacaaaatacttcttgaaagaatgaatgaactgcccacctaagaaatcctctgataaatgttcttttttttctcctcgtttaaaccaagagtactccaccacagcattgctgacctttgggaccagattattctctgttgctgggggctgccctgtgcactgtaggacattcaccagcatccttggcctctgcacattcgacacgaatagcacacacacaagggcaagttgtgacaactaaaccatctctagacattgccagatgtcccctgagggcaaaatcacttccagtaaaaaccaatggttcagactataggaaagcaaaaaaatatatttttgaggctaaaaataacttaactttttactatgtccctgaatccaaagctgttttgaaggcttagcaaataatatagctataacttagcatagcaagtccttagagcaatttacaactgactggagaatattaaccgcctaaggcaaatcagtccttaactgctgctattctgggggtggggagggggacacagcattaataattcaataaaggaaaggctgcaggcaatgagaccctagagttatttatttagccaattagattcgtttttggtggcaaccctgcctttgtgagtatgaatacgccatgtctattcttcaattaaccaggaaaattgtacctcacaaatctgctcttactgcctttcagctggaggatgtgcagttcaagtggtcctggagccttcagaggagggaaacaggctgggaacattcatcacttacacgtgtgcctcacacagaacagatccatgcactgggggtgtgcaaattagaggtgtcagcatcagtcctcactgttcctgccctaactttccagccctaatccagagcaagacagggatgaattatatcaggtaaaatttagagccatggacacatagatatgctcagtttattactgttagtgataaacaatcctactttaaccactaagagactagaaaacatggttttttgtttttttggttttttggtttttttgagatagagtctcattctgttgcccaggttggagtgcagtggcatgatcttggctcactgcaacctctgccacccaagttcaagcgattctcctgcctcagcctcctgagtagcggggattacaggtgcataactaccacgcccagctaatttttgtatttttagtagagatggagtttcaccatgttggccaggctggtcttgaactcctgacctgaagtgatctgcccactttggcctccaaagtgctgggattataggcatgagccaccatgcccggcccaaaacatagtattaaatatacgtctggtgaagcaaatccaagagctttcctgttttaactttgctcacaatttaggctgcaggaactgctggaggtccctgaagtggacctattttggtggcttattttggtctagatcacaatgtggaaggtgtccctatcactctcttgtggtcaataggaggtcaactcaaagccctacagactacagtagctaatggggattatttttttaaaatcatcaggaagaagaatatataaaccaacatagtcctgttcactgggacaaaccattagaaattctagagatttctccataagctgttagagattttctttttccttgggtatttataaccttagcacttccatttctaccatatattttacttccttttccctttcttgctctcctttttcttttttggttccacttatttgtttagagcccagattctctaataattacaggtggcggcaagctgtgaggcttcacaaaaagtcagatacttagaccaggaaatcacagaaaggccactgacaagattccaatgtgaagatgcccctgaccattgacttgtcctcgatatctaaacaaagagcacatccctaacagggggaccaagatttcttatgcacacacacatctgtctgtcgcaggccttggagacctgggatcagtcagatccccaatgagagcacaaaatggaaatcacatctccaaaccacttttgtttcactaaaatcaaactgatgtttcagtcaacaaaacataaagagtttcagtgcctcatgaaatttcactgacccaaaaattacttttgtcaacccaaacatagctttcttttctcatttaatgtgatcgcagttgtgctcaccaagtccagttgagtacagagtgggatgcccgtgaatatgccaggagctgagagctgaacagtacctgacatttcacccatttaaattatagacttttcctactccagaagattcaggacatctatagcatgtgtccaaatgtggcacaaaggaaaaatatcttattaactcagcacaattatggggtctgagatcagaggaactggaggccttgtaatgtagagcagcagcttacaggaatggaactcagagcaaataaattttgattgagacaggaagaaaaaggaaaaacacaagacattacctagagtgagcatacctaaaggccaagattctgggtgagtggaaggtgggaggaaaaacagcccctctcaggcatacaataacaggtgatgtggataccactcactggaagggaactggggatgcccagtggtgtgccagccaatgtttaatgaccacccatcggaagaagcccttacctgtggtgtgtgccaatttccatggtgtaaacactcccaccatagcctacattaagctactatcacaatgtcactgaacacagagacagggagacacgcacacaattggctctcacaaggtaggaggaacagctccagcacagagcacccctggcacaggaagtggaactgaaaagaagctgggcaggggcctggtgcccacttcttttgacaggcgatttgtgtgtatggggcttctgtcttgacacagctggactttcctgatcatttagtctcagaaactgaatggagattgtttcctttgtcactcccaattctgctctgtgaaattcttaggaatttaaaaattcatgatgagcacatagtaacttaaattcaaacatcaaaggactgctcagttttttctcctgttgtgaccttattgtggtaaatattgcattaaattgccatgccaataattgagattcagaagcactttagttttgaagaaatttgctgttcatggcatttagtgacaaagattttcaccttctcattccctatctctcttcattctccttctaccactccctctctctcattttctctcccataatgttctgtctttggggctgtctccaaccctttcccatttatctttccaagtatctctatatatctctttctcaacttctttccccttaccccctctccctcactcttctctcaacttctcagtaagggaaagatttctcgtcctatctgcataatgtgtctgacaattccagtctctgtttgctaatcatgcttaaaagaatgacataccagaatgtagagacaacaggaagaggtaaactaagggaagcactgaaaaataccaggcataacaaaagcctgaacaagctctgcatgcataaagaggtactatgcattaggcatatggacttcacttgagattatgtaccataaacaagtacaacatgacaaaaaagaacatacagacgtggagtaaactactgaccacttaaagctggctgaaaatcccacaatacggatcctgagttttacttcccttttcttctctggttccccttaccctggtacctgccaaccgagcctttgatttaaacatttttatatatcaaaagatacagaagaaaaaagtaatttagatgtaaacattgaaacagcttatgttacaaaatgagtgcagttttaaaaaataaatacgcaaagccttggggggaggagaaaaaaacagctttgaagggaatagacaaataaaaagcccactaaagacacagatcattccagaggtgattccttctttctgcctgacacaggctgtgtggccaacatatgtatcaacagacaggaagtaacagaactccaaaccagacaggcgctgggagctcattctatattcacagaatcatattcgggaaggcagggtcccaggaagtactaaatcaaatcctgccacttcacaataacaaggaaaggataaaatgaattcttgatagccacagatttttcagaggaaaaaagaacagattttcaacttgaaaccattacattttagacaactttttaaaaagcttgaatttcaaggattagggcaaagtacgtgctctgtgttcctctgctaactgaaactgaaggctgtgttcccagttcttacagtcatttgacaaatacatcaacaagaattagccaccaacatgatttccttggcctcccacagtcagaataataaaaagaaattccttccatgatctctttattttaacacaccggttgttatttagtgtatcatcaggaggctgtaggcaaatcgctggctggctgtcacagtcaacatcaacccctttgaagtcaatgacactaaatggaaacactagaagtgccattaatgagcatgttttaataatgctactgaagtcttttacatttcaagaaaagtaccagaaataactctgtagagtttatggtagcacgattgaagtgttgctaatcattatatatcggtttattaatcattataaatgccatcacagttaaatgttatttggattgttcatatgcttaacattgaaggtgtaattaagaaatggcctgattgataccaggcgagtcggtctcagttgaactaggatttcattgaatgtagtcctcagggtggatggtattgaatggatccacagcactggggttctatggaggttcttgcatcaacatcccaaaagttcgggtccttctctcctcctccacaccctccattacacaagtgccccagagtcagcgtagtatctatccaacagacacccatgagtggggctgcatatataacaaataaagatactggatgtggacctgaatttgaatttcagagaaacatcgagtatttttgttagattaaatacaaatttaagataaacagaagatatataatttgttagtaaagctacagttcagacttagactaatgtaattattcattgtttatctgaagtttaaatttaactaagcgccctgtattttatctggcaactctacccaggggaaacatgtgtggagccttttatggtctagagatctgcctctaggtgggaccatgatggccatctgagcatatgtacctgtccttctcccacccccaggccctggaaattaaaaaaaaaaaatagatgtgtttaacgagaaatttcacaaaactgacagaagacaaggagaaggtgtcatgtgggtcagaaaccttgagaaattcctgaaagacagaaagaaacctggctcatcttaacagaggaaattgcagcctcagaaatgaactaaaaaggttgctggaaaatgttgtagtatgtctagggatgccccgagctcagagacaacaaatgcaatgagcaaacgaaacagaagctatagagattaattgggggagcatgttcagaagtgctgaacaaagagtgcctgctgctccaccctgtgtcaagcagcaggagcatagtctgtctagatagagccaccagggtgaccgcttgggctatagaggcagagaggtgccccgaatgactgttgataattgggtgcaccagaaaatgagaacctgctatacaccaacatcctcaatgatctccaattatatggaaagcaaaatggaatccacagataggagatcacagactctcaagatgaccaaaattattagaaaaaccaacatcaaaataaagaggcattgaagagcagacacatgcagaaacagggttaaagtagcaactattaggctttaaaagtagtgtaattaatatctttaaatatttaagatatcatctaatataaatgaaaaagaacaggctgcaatggggaaagcatattttagaaataaaaaataggattatttgtaatttcaaaaatataaaactccttggggaccaacccaaatgtccatcaatgcagactagataaagaaaatgtggtacatctacaccatggaatactatgcagccataaaaaggaatgagatcatgtcgtcttcagggacatggatgaaattgaaagccatcatcctcaacaaacaaacacaggaacagaaaacgcaacaccacatgttcttactcataagtgggaggtgaacaatgagaacacatggacacagggagggggaacaacacacacaggcacctgttgagtggggtggattgtgagggggagggagagtgtcaggagaaatagctaatgcatgtggagcttaaaacctagatgatgggttgataggtgcagcaaactgccatggcacatgtatacctatgtaacgaacctgcacgttctgcacatgcatcctggaacctaaagtaaaatcaaaaataaataaacaaataaatagataaatacaactccctgggttaaattgcaaagttaacacagctaaacatcaaatcaattaactggaagatggcattgagacaaggagacagtcaagagagatgtgtaagctccagaacccactgaatgaaagttctagaggggaagaacaaagatcatcgatgggaggaaatactcacataaaaaaaaagaagaaacagaaatagaaatgcatggaaaaaaatggactcctcagactataataagacagaatgcaagaagaaaccttacatataaagtgatgaaattctgtaacagatgatgagaaaatctgaaaagctgtctaaaaagggggccagaggtagaaaactttacctatgataatctgcttctcctcacagttctgaatggccacactgaatgctaaaagacaatagagtcatcttttcaaattttcaaaagaaaaattgttgtgattttgaaattagcaccctctactccacaaacttgtgttcagctgggagatttctagatatgcaaaaattcatagtttgccaaccatagattgtctctgaaaaaaaaaaactagtagaaaatgcatacaaacaaaacaaaacactatcacaagttatgggaagaaaagtaacatacactataaagtaagaaagatacactggtaagtacaagaaccaataaaactttcatttaagcctaagtaactgttaattggaaatcaaaaaattaataacaatctggaactaaaacccctggaaaataagaagttcacattaattatggtcttacgtggcagcaggcattattctaaactctttttgtgtgttagctcacttaatcttcacaataaccctaaaaagcatttactactattatcattttatagatttggaaactgaaggccagggagttaaaaccttggccaaaggtcacagaggtaggaagggatgggtttgagcaggacaccaaccatgggaatcggctccagagactccaggcaacccataagctcaggcgtcaaggctgaagggtggaggtttgggggaaagatggaaagcagtgaaatggggagaggaaggttcttgtttgattgttggttagaattccataataattccatatgtggaggaagaggatatagttcactctactttaaagagttaagtgaaagtgttaagtgtgatctctaacacagaaatagaacatacaatttccaaaatgataggacacccctccactcactccagtctttttttatattgcttagtagaattttatgtcttgtccatatggttgccacatattcttttaatttttaggtattctgtatttttcctgtcattgtgaatggatcacattatgttgttatatatgaatgagcaattgttagtaaatagaaaattaactttcgcacatttattgtgtaactcatacccctactgaactcttatttttctaatacttataattggtcatcttgtgtttggggggccaaaaatgtggactaattttatattttccacttcaacatgcaaaatttttctatccttttttatccagctgtattgcatagaacttccctaaagcattaaatcatacggggatagctgacctcatcatttcaccacctttaaggggaagaagctggttaccccatagggtagtttatgttctgtgtctataggtactgaaggagctgttgaacattctactaaacgcttgcctgtgaggctattcagtccccactttggcttctcgagtttcaggctgaattactggctctttcctccttccttggacatgtaaaattggtctagattggcatgtccacctacacatgaacccagatgaagtctcagaggaaccacactcctagatctcaccactggacattttacatcttgcgtgatgtttaagagacacttataagatgactccagatgcaaaatatgctgcctttcacatgtaagcttcttgtgaaagaactctggacattaattttgaactatcatattctaccatcattctgtcctattatcagcctgaaagcatgttattcattatggccctcaggtcaggaaaatcaatgactaatctcaactctgtatctattgaacattgatagctgcatgggtcatatgtctgacataagactttgtcctcaagttaatcaattcctacactgatgcggcctatgctctctcacgcagcccttgtgtgttcccagatgacacgtatttatttacaacatttacttgttatattctagaataaaattttcccatttggagtcttttctgaaaacaaaagggcattaggtctaggacaaatccaccataaggttcaaagattttggaaagaagaatgttagaaatctatgtatgaagttctttctgaatcgagcatattttaatatggactattttcctgtgttcttttgcattttaagtcaacaccatcttcttctcaaaagcatcttttgacatgttcaatggttggttggtttgattggtttcatttctggctatttactttgtggttacctccagagagaaatcacttaacattttcatgagtatcaggcctctgaataacgtgaaatcttgggcagggctcatgtaccattttctcaagggctttcccaatactcagtcaggcaggttgacacatacaaccattacatccaaaaagcatccttcagcagctttggcccaaataaaagaaacagaattgagctaacaatgagttcctttacttctaatgaaaattgctcaacaaagaaccaaatgttagcatatatatatatatatacctgctctcagaatgcttactaaatggcaggtgcggtgttaggcttggggtataagggtttccttccatctaattaaaattatgcaaaagggaacaaaatgtcagcctttccataaaacgcatacctttggaatctctcttaggaaacaggccctgtgtctggctagaaatgtaaggtgggaaggagggccagggcacccacagggatggcggtaaatgtattttgccacaagtaaatggattgtgccagatgttgtgggttacacggccaatatgtctgatctataatattcactttaagtataagaaattttgagaaaaccactcttcaaatagcatgatcaaaatgattcaaatagaatatttttaagtgaagtaggtatttaacacttaagaaacaaaagtgtttttgaaaaagggcttggaggctacgagtggctctaaatgggaatagctgatataaattgtcagtggatagattatttctaacatcatccattccaataacagtgcaaatttctatctagtaagttactcaagtgagtatctgctttaagtacactgacttcaagtaccactcaaaatttctaatctttggctatgtgatgtcaaactttctttgctactaaatgatctcacatgcctctagctccatgctgctgttgatgttttcttcttgctatgtgattttgcagaagacatggaagttggcaggctagctgaaatgaatactccagaaactcataattagagaagaaaatgattcttatctactccccaaacatactgaattccttggtgaggctatgcaggtaagataataaaaaatacataaaatgtctgagcaaatttcatcaaaataaaagcatttaacaaataagattgtcaactttcttctgctcatttgactaaaaatttaaaaaaatagcaatggatacaatttgagaatactaaaacaggcccaatatgaattcactaaaggcctaacacagcagaggagaaaaccaaaggcaaacataatatatcttatttaaactgacacaagctttgttttgacacaacctatggttacattgtagtttttggagactgtaaatcagatgtttaggactgagaaagaagaaaatagaagatcattttcttctttcataggatccattatttttctccgtatttgaaaaaaaaattttaataattattacactaaaattatgctttggctatcaatattttatttcatgagatatcaaaatcatccactaaagcagatgtataataaataaataaatgtattcctctttcagggcaatatccagttgctgtactcaagcaggctggtgtgaagggtcacgtgcagctcttaaaataaatggtctgcaaagctccaacactaatgcctaatcccatatcttgtcctgagtatgtggccctcttcccggggatgccccctgtgactccttggggcaaacctacttagagaggtctaaggaagcctgcccaggggaagagtgtcctggacaatgacctcacacttaggcaagacttaaatctggcttcttttattcaaattatctcagagctggtaagtggcaattggccaatgctcaggctgtccccactgtcacatgtggcctgcctttccactgtgtcttcttctagatatacaaagcagttacagcaggtactgcacctattgctttttgtcagcctcatggagtggctcttatgccacagagttgtccaaacccatgggcaaaaacagataaaatggaagccaggagtctccacccacagagacagggacaagttattctcctcagatgtctatagaatgtggccagcacattgttcgcgatgtcctcaagttcagttttggacagaaacggtcatacttatatgacacacacccatttgcctcagtttcccccactaggagacagtaaaaagattggtggttgccaggggctgaggggagggagggatgaacaggagagcacaggggattttcggggcacgagactggtctgcatgatgttctattggtggatgcatgtcattacacatttgtccaaatccatagaatatacaataccaagagtgaaccctaatgtaaactatgaactctgggtgataatgatgtgccaatgtaggttgatcgattgccccacccccaccagccacacaacccacatcagcactttgaagttattctatatttatatacttagattgcatacacaacctgaagacttgaatggatgcaaatgcaggcaaaacaataaggaggtaacagtttataacaggcaataaatattggcaaatttcctgattaaagtcaggtttagatttctatcatcaacttcagtgttgtctttcatcagatcacctttaaattaccactgccaaaataatattaaagtaaaaagaaaaacaacacaaaaataacaattctttaataataattaagaaaagatgttgtattaccactaacattttacccattcaaaaggggcatgatgccctaatgccttgaaggtaaacctggtagtcctacaatcatgagtggatattcttattcaatatatgcattgtaagaaggaaccacagataaaatcaactgacttgccagcagtggtcctcaacttacagacaaacacaacttgccactattctctctcttccttggcaaatctatgaccaatcttcctggattacagatagaagacacacaacagcttttataaagtctatcagttcatttggaaagttcattccttcacccaaaagctatttattaaatgcctgctgtgtatgacacattcttcttggaactgcggacccatcaacaaacaaatcagataagcaatggagctcgtatttggatgaggtaggaaagacaaccaacagcattcaaaagtaaatgttatgagttggaaagtggtaggttccataaaatactataatcacttgttgatgacttcttctgtgccagaaaaacacaaattaccaataaagtgttattgcacctttttccagaaaagaaaactaacgttcagaaagattaagaaccttgctgaaattcacacaaatgggaaagctaatgcagggattccatgtcacatcagagggagtttttctagtcatttcacaattagacccttaagcaatccaaaaatagaccccattagttatctgaatggaggaaaccaggctctatgcatgctgcactctgagcaagaagttaacacattgatcctggacaccagacaacccaacatccatttacctccctgagacccaagctcctcattatcatctccctaatgtttgcaacatgcaattctatttactttccatttttacataaatctttatttagaagaaaatagcataccatggaatattagcctgtgctaaaaagaaatgagctagcaagcaatgaaaagaaatagaggaacctttaatgcatattactacgtgaaagaagccaatctaaaaaggctacatactatgtgattccaaatatatgacattctagaaagggtcagaccatggagacagtaaaaagattggtggttgccaggggctgaggggagggagggatgaacaggagagcacaggggatttttagggcatgagactggtctgcatgacgttctgttggtggatgcatgtcattacacatttgtccaaatctgtagaatatacaacaccaagagtgaaccctaatgtaaactatgaactctgggtgatgatgatgtgccaatgtaggttgatcgattgcaacaaatagaccactctagtggggaatgtcaacaatggaggaggctgtgaatgtaagagggaggtgggataggagaacactctatacttgttgcccaattttgctgttaacctaaaactgctctaaaaataaagcctaacagttcataaatatataaatatatataatataggcctattagttcataaatatataaatatatatacctgtaaatatgtatgtagcagcatctatctatctatctatatatataaaacattatatatatataagcatactgtcatctcatattaatgtttattcaaaaggttgtacaatcctacacttatacatttttttgaaaatggcctctatctttcccacacttgcctagtttgatcactgtgagactcctcaagaatgatgcccggtaaaattaattattaattattaacttatttatttctatggggagaacatcagtacagtatttctgtttataaaacagaattgaaagccatggggcaatggaactaagaagagaaaaatctaattagggcctgacagcctttgataataggattaaagttattttcctcccaactactaatatgtgaagtcaatagtgttgtgttttctcttcttagaaatgtgtggtatgcccctgcaagcaacttttcccatgctataatgtttgtaactcacagaaaataaatatgatttctttgatgcactatcaggaagatgtcagcaaaacatgaagtgacacacaccagcagcctctcagaaccgagctttacagaaatggaaacttttgaaagaatattttctagcagcaagtaacaaagtatctgtttgaatttgtttcttaatatgctcaggttcaatgcaaagaatgtaaggttaccataactttaacaagcagcatctatttccagcatgtgctaaatattgtacctatttttggtaaattttaaaaaatatattttatataaattcttatctggacctgtacttcaaaatgttcttcataaaggctgagcataaaaattcctgtttaatcaaaccaaattaaatcagcaactatccacagagctcttctcccttgtgcaattggtattgtgggcataataataaataaaatttaagatgtaatttaagatcttggcctcaaggtgcctatctctgggggctataggagagacaaacaggacacatcaaagttaattatcttttagctctcaaactcaagacaatcatagaaatagaacatcaaggcagtacaatatccattcaaaaattgagtaggtatatggtgatggacatagatctccttttccttctgaatataatctctttgctttccagatgaatttccacaaatgagaccttaatcagaacagagtctattcaggacacatattgataattatcgaggtcagtggctccccaacgcggctgctcatcaggagggcagatgcttcctaattgacactgctcctagcccccaggccctgatcttctcacttagtaggtcatggatgagtcagcttctgccaaatcccccccttcaatgcccccctgaaccaaactaacatttgtacagcactttagaatttccacaatgtcccttatcctcctaattttttaattctgtgcaaaatcattgttgccatcttttagatgaaaaaacacagattgtataacgtgttcctgttttcagtcagtgaataataaataccatgggttaaatttagatattaggcaagagatgtttccaaaacaagtattttgtgctttagactagcatatatcagtggcatcaaatcacgtacaaaaaattatgctttccaaagtatctggttcaagtgttcaaggttcttcctaagaaataacaaatgcaacctttgacatatttcttttaaaaatttttaactgtccatatatattaaaatatttattctgaaattacaactagaaatttcagtaaaagaatatttgtacctatgtgcacaaaccaacttcaaaaccaaagtaattgtaggatattccaaagtgtttaaattctatttttctttcccctttgaggctgccattattttaggtaaaacaaaaatctgtgttccttctaagccataggacttcgatatcttcagggatacctggcgtccctgtgagtaattacccaggcagtgattaaaccaccaatactaggagtcagcaggcaggctgtgtccacaataggagtttctgaataacaacgtcacacaagagcaaattcaagagctaccgtgaagcccactcaagggaaagcaagcaagtaaatgagttgaaactggaggggagaagctgattgttacaggagttctcttgcccttagcttttacccacccaagcaagacagcttggttctctgtttgcacaaggaccatgtttagaaatagaatctgtgctccatcattaaatatatatttattgaatccctactagtgccaggccctgtagcaagccctcgaatatgaaggaacaagactgagccccactgtaagggagtttacatcattgaataaccagcccctcaacaagactatagtgagacaagcgtacactcagcaggatgcgtccacaggaggatgaagagaaaactggcggggcctccggctcccactagttcttgacagagcaaacccattttctttacatttgaaagtagacagtaatgggtaaataataaatcagactatttgtagtttatccttaattcttccagtttagcaatttgtccctcttatttacttaaactcttaattcagcctgcttaatttttcttcatagtatttgtttttacctgatcgactgaatactcattggtttactcattacccctctgctcccctctcccatccacacacactagaatggaaacttcatgaggacccagatttttgtcactgttgtatccccagcatgctgggtacatagtgggaactcaatatttcttttatttcattattattactattattttgagaggaatctcactgtctgtcacccaggatggagtgcagtggcatgatctcggctcactgtaacctctgcctcctgggttcaagcagttctcctgcctcagcctctcaagtgtctggaattacaagcgtgtgccaccgcacccggctaacttttgtgtttttagtagagatggggtttcaccatgttggccagactggtctcaaactcctgacctcagatgatctgtccacctcggcctcccaaagtgctgggattataggcaagagccaccatgcccagcctcaatatttcttaagtgaacattggaataatgtcaactaatgaagaatgtataattgtataatctgttaaaatgcatttcagatgaagcttaagtgtaatatactaatagaagtttattttataaggaagcactagaaacttccacctagacagtccacagaggccactgaactgtaatgaagcagctatcactaacattagaattacagtgaatatagccaaaagaaatattaccatgtttttttcagatcagaaaatatgtctaattcaacccagctgggatgtggcagggtcaaaatttgaaattcagagttgttggaacttaaggtataaactctgtctgctcggtcaccagcctgcctgccaagtagtcaagaaaaaaatgaccatcctggagtattcaattacctgaggaaggctgggtctccaaagggactgcctcgatttttcacttctacagaatttttagatatacatttccacaatttacagataagtctatgaggatctttttaaagcccataaaaccacacacacaacctgctaccagctaccaggagtgacaaagctccgagtggagcatttgagataatcaccattcatttgtgttttaatatgcatagagagaacaggccttgaaatagccttgcatatgaattcaatatttgtcttttaaactagttaatctggtacagtcttacaaatgcaatgccttattaaagagagtatcacatggtagcatttttctctcccctttagttgagcacattagatacttatagggacatggtatttctctcagaaacacttgggagctagtgaagccacaaagctaaggagataatcagctgatgatcaatgatgagctcccaagagtaaccagcctctatatagtcagcatcactggtttctcaggaaaagcatcaccattgttcatcttgctgcaaaatgtatgcacaagtatctttttatttttaaaaaagccctgacattttatgactgctgcttttctaagatattttcaaatatacagtccatacggttcagacacaatggactggggatagagacggctatagtgccgataatggagaaactagccagagcttcagatatttgttttccaggacatctcaataattgggtacacctcacaatatgtgagacttgacgtcgagtggcacggcatactctggcgcaggcacttgataaagactgtgtttgcaaatacttagcctgcacttcaagataccaggcatctaagcacgtcccagatggtgacagttaatcttcaaaaaaccctatgtggaagtattatcattgtcctcattttacagatgaggaaaaagagacacagggatgtcaatatcttcctcaaggtcacacagcaagtaagtgatggaacagtggctcagccatgaagctattgctgttaaccactaggttgatttgccttcattaatttcttcctaaaactgcacatttcccgttagtccctcttttggtctgtcgtttgactcttggctactgcttagaggaagattcattctattattttctaacttagtaaattatgtgcaactccttggggacatgacacaggcaaagctgtatacagagatgtatgccaagacaccatcccaagttaaccctaacagtctatctgatcctgtatgtaagtgggtatattgtaaatatttttaaattttctgtatactacgatgttttgatagtttaaaaaagccttctggctgggaagagactgcccctccctgggctagtcagttcttaaagatggccatgggcccaacctggagcttacctttgatatgaaaactaactgatgcagagccacacctcctctgtttgggccatatggccccaggaggcactactcctctgtcataaccatcctggggccaggcaccacatttatgataatatatttggaagtatatcattatcataatctgaggtgtctaaatacagcaatgtcaccacgaggggaaaaggactttcattcaccatccatcgaattctttggagataattacaaactttgtaatactttatttcggttcagaaatacaatttagaaattttaatacaaatttctggaagttctgacatttttaaaagataaatttaagcttgttatccttcagcttgctcagactactgtatggatgctacgtggaaggtggttgatcattgagggaccatcattatgaagatgcggggtccacagcgtacatttcccagccgagatatagcagcagggaataaaacagtgggaacagtagatcagcctcatattgcaaatcggcggcacacaccctggagtcgtttgtttcccatgagcacgttgtctaagtactacgataaccaactatgacccagtaaccttgtcatgcctggggccattatgactcaagactgcatacctggaatcaaacttaaactgtgaatatatatggcatgtttagcatgatttgggctgggttaggtgtggaattgttagcctgtgttttcgtctgtatttatttgacatgttctgtgtatatgattaacaattacagaattcactctatcaaacagatatattagttatggcaagctataaggaacgtaatgaaaatgtatgaatgctgcaattatgacaatgccgcaactatgtgtgtaaacgcaaagcagtggatgtaaacataggcagcgaaaggtcctcctcctaccttccatgagaaggaggcttgtgcttttgtggtgccacctggtggaacaagggagatgagagaagagagtcctgaaatggttaactggcccctagagacactcttcacaataatccaagtcctatgctcttaaaacttcacaaacctttatggagcacttgaaaaacaattttttaaggaaaaacatcaaagaatttagtgtcgtgtccttattttctttccacctcacctgactcaatttccccacatgaaaaaatgtcatcaaatgccaaataaagaaaaaagcagagaatggataagaacaaggggtgtatttgctaatgaatgcactccaaaaccacagaaattaacaaggttacaaagcagcctagcttccaatggaacacaaaggatgcctcattgacctagttatttgcatgtttgtcttcttcctccattaaactgcaagctatctgaagtcaaagtaacattatcagtcaataccttacatagagagtacactctataaataaactaatgtatgaacaggaagtttgacaggcagcatctttactcatggtccagaaatggacagttcagttctttagtattttacttctcttttatcgctcaagacaaaggatactacagcaatagcagataaataacaaaaccacaaccccatctatacacagatattgctgttaccttcaaagtgtcccagtctggttgtgtatcattaactttcatccactaataacaaaaaccaaacatcacatggagcacagagcacagaagtgcttccatcatagagtaatatagcaagaagaaaccgaaataagaaggcttggggaaaaaagtctgaagctggttctgccctgaaaaaaaaaaggttttattttacagcaataggttcataaataaatagaaaacaataagaaaatatatgagatctgaagctccattagccagtatccatctgttactcatattttaatatcttctatatcaccctacagcgcaacatatgcaattaagaagaaatggctatgcaactttttggagataagttattgtcaatgggccaaccacacagagccagatgtaaattactaagtcaatttagcaccagtttataaagttttgattaatcctcagctcattttatgttattataatgcattattaaatgcagcgcatggcttgaacttgctccttcataaattcactacatattgatcctgatggtggggcggatgtcatccccatggggcctctgaagtgatattctttccaaatgacaagagagcttctgctcataagacacatgttaagaaatatctggcaaaacagcaaaccttccaacggttttcatcatgttagcttttgacatgtgcatttgtaatgaaagtgcgtcttgtagtaccagcaagacactcattttctcctaactgatccagacatcatcccactccatcctcagggaacccactgagctgatccatgctgatgtcacacaatggcccacactgaggtttgctgaggatagggcactggataaaatacaggacacccagttcaatttgcatttaagataaattatgaataacatcttaatataactatatcacatgcagtatatagggtatacttatactgaaaaatttgctaattctggcaaccccacatgcagagtttcaggttgtggtctgtgcctggctgcggtccacattatatgtgttttaggagaggaatatgtttatgctacaattccaagcacacttgctccctcctgaggctttccctgccttcctggagcttgccaacacacctcttctaatctggcgttgactgtatgagaatctttcatcaatatcttcagaagttaaactgttaattaaatatcaagctaagttaatatcctagtggaagaattaaccatccctgcctttatgaaaaaaatctagatactaatataatggtccctgtgtgaggctagaatttcttacactgattttcttgatatttatgatgatttaatacaaagactatgggaagaatcaacaatattctgaataaaatggcttttatccaattaaaatatacttggataacaaaacaccacagcagtttcatgcaattgtgtcaaaatggttgctaacacaatttaatctctgacctctatttgaaatttcctataacacagaaaactaaagtctatgcttacttgcattcttaaaatgtagaaggctgagataagagaaactaaattgccaatgaattacctttactctaaagataagtgtcaacatatacatatgtgtctacgtgtgtgtgtatttgtgtgtgtgcatgaaatactgtattaagtatacatataaaaacatacacacacatccttctgagttttttcctatgtagagaatacagaaagagcattaagtgggcaaaggaaagcatccaaaagcaatgtcagcaatggaggagttcagaaacatgaagtagatgctgatgttagccatatcccttcccctactcaagagaaggaacgaccagctcccttccctcctcctgctggaatccgggctctgggctgcaggggcagcagctgtttacaccctttaagtactgacatgaagacaaaaactactcgccaaagatgactgagcaaaagagaaaaaagcctgggttccaatcgtcaccccaagagcacccaaggactcaggacacatagctgttacatgacaaaaacacaggtcttggttggctaatgtgccaccaattgggttttcccataggtgcagctactcattttcctgttacaaaatggaaaacccaaaactttccattcatccacccgtagaaaacataacttgctcagtttctagattgttctactgtaattactaagcataagatggaattgaggtatctatatttttttgtggcctagagactatattcaaactgatgaaggctaccacagaaacctaaatggacaaatatttaatcatgagcattctgaattggctcttactctttgtccctaaatatttttttaaataaaaaacaacaatattgaggaagtcactgaaagatccaggttaagaactgaggaaacacaacacattcctgtgttcagcatggttatttctccttgagggtagggtttatttctctgtagcagttaagacagaggatgggtgtaacacgcatagttggaatttaaataaaagcagaagcagccaactatttgcaacatgatgaagttccctatatatttaaggaattatccacagatatatatgaatatcagaggcaccatttggcccagggtgagaatgccaggctgagccaaccatactttaagcacatgtgatttgaagtagctgagacattcatgacaagactgacagtatcccagcaaaaacttaggccagagatagcagagagctggcctggagtcgctttcagctgtgggtatctctaaacatcctgtgtcttgagcttacagagttgcatgggcttcctcaagtgtcagccagcctagtcctgcccaaggaaacatgtgctgagcttgtcacttggtacttggcaggctcgcagagaaaccagagagcgcagtcatagtgggaggcctttagcactgcagtcctcaacttcaaggagaggagcaagcctttgaaatccaccagagacaagatgcctgagaaaacaggggccactctacaactaaataccctttcccaaagggttctaattgggggaaggacagagtgacggagaaggaagaaggaaaggaaagcaaagacaagaagaaaagtgtcaggggtcaacagattttgttccattctttgatttcctggatattttcccaaagggatggtagcacattaaacctggactcaaccagagctacaagttttatttcagtgaaggcattttcttgatcattttgcactgtgtccaaataatgatagcacagggaatacatgaataactgggataaagctgtcagtgaaaggaaacagagcctctggcttctccagtattgaaaatagcataaaagagagagagagagagagacagaatgaatgaattcaaaatacattgtgaaaccactcatccatttgcaggactaggtacgcataagaggggcacttcttcaccccccaggaggaagagacttgtctgactttcttccttaggaacacagaccatgacctaaggcagaactgtgaggttcagcagggaagaggaagctaaaagagccccgagggctccaggcacaggtaacatcttggatgctcatagcaggttgctggggaaagcctgtctgtatctaggaggtggtgtcctagagactatctatttccatgaaaagctcccagtgagttaatttcagagccaaacacaagagcctgggctcacaacatccatgttcactccattaccatgtgctactgagcagattcatccacacgctggagccaaccttgaatggtttcaacttcacatggaatcatctctgtgtattttatgtagcatcctaaagttgcatttaaaattttaaaaataaacacttcaaatgttggacaccttctcatggatgaagatctgcataacagcactgctcttacaatgccatctctctttaaggatagaggagttcattgcccgccacactgggaatattataaaacaacttcttaggatgaaacaaaaattaattttaagtcatagatttatttaaaacccaaagatttggcatcatttaagtcaataaatgtccagagtaatgcctggaacagacaaagtgctaaataaatggcatctggcattcaccattccctctaattataacgaaatacatttcacggctgggcgcggtggctcatgcctgtaatcccagcactttgggaggccgaggcgggcagatcacaaggtcagggatttgagactagcctggccaacatggtgaaaccctgtctctaataaaaatacaaaaattagccaggcatggtggctcatgcctgtaatcccagctactgggaaggctgaggcaggagaatcgcttaaacccaggaggcggaggctgcagtgagccaaggtcacgccactccactccagcctgggacagagcaagactccgtctcaaaaaaaaaaagaaaaaaaaaaaaaaacaaaagaaaagaaaagaaatacatttcactagcatcatattatacattgcaatcttcttgctaatattataaaaccaagaaaaaaagtttatttttacaaatacagtttccacaaaactcaaaaaacctcttttcattaatgtatttaggaaatattcagcttctgttgttttccagaaacttctgcaagctctagagatgcagaagtaagcagggcaaagtcccctttcttgcagaacgtggattcacatcaggagacaggtaataaaccaataagtaccggggtctcaaatgcaacagcaggtaagcacaagtgctgtgaagggcagagcatggtgaggcgcaaggggaatgcttcgtaggacttacacagagtggtcagtagagctgcccctgaagaggaggcatcagcacagaacccttcctaaagaaaagtgagtacatgaggctgaaggacaggtgcaagggaggaatcagtgaatgagggcaaagaaggagctgggagccaaatcatgggagctgggtcaccacaggtcccgagcagagataccacattgacagcaacactgccagcggattataccctgatgtccaatcaatggcaagggccaaagcatcgggttccttttatgttatatcctcatttttcaatctatcaccttctccaaaggcttccattttcctctctgttttcctcacccctgtgcttggtgtaatagatagtatccgatcatcatagcagccttgtaactcatttttaactgaaataaatacttgttacttagtacataatttctcctgatcaaaaattccaacaaagttcagaacactgaagaattgaaattctaatttagttttactatttatcctgcatttgagcagaaaagacaaattctaaaacaaaaaaaaaaaatctagaaatatttagtattcctacaatgataagctgatttcatatcaaggggaccaaggatgtgagtcccagttccctttccctgccctgaatctagcacttatttctagaaggcaaaaggcaaaagcatttcgctttcagtagagagctcatttgggcttggtttttcctgaggaaatccatttagtataattttttaaaaattaaacttcacatgcctatgactcaaactttcaaaccacccccacactccatcagttattttcaataattaacagtgggtgatctcagatacagcctggatgttttggaaaacaggaaatagtctgctagattgtagcctcatattccccttggaaggcttcttgattgaatgctacaagttgtcaaaccagactggttcatttgactcccctgaagcgcttgcaggagagttacttagtctctctcttccagaaaggagagcagccagaatgccagaacccaaacatagtcaccccaggactctggtgaaggagaaccttgcaggtggctcccaaaacacctctgctggcagcttttcccaagaggaaggccaaatggccgaagctaagtcaatgatttatttctaactgctgctaggaggtatcgtgcagggttatggataagtaccatgacttttctttgttgtctttgactttctggcttacaatttctgtgatcaataggaatagtctcaaagtgagcaatcagaaatttgtcctggtagattaactgtcatgcaagctgcaaaacagagccagatgaaaaatgcagaaactaaaaccataaagaatgagttgagatatcaagagaaatggcactggactactggtggtcctcaacctcatgtgaaactttcaagtataattaaagtaacacatccaccagaataatttacattattgataaaagaatagaaaggattagataatttaggcttctttttagaatcattagaagactgagcaatagacaaaggccaatttagttgcaaaagttttaattttattttagctataatggggacactcttttagcaggctatgtaaattgctttaaattcaagccattggtgaggagttgctaaagttgcccgatttcttagtttgtttatatctgcatttagctgctatgcaatgtattaatacatgaagatctaataagatattaaacagctctaatgttcagggtgactcccaaattatttttgaaaaattaatataatgggtcatattagaaacctttcattttgggctgcaagtaactatccagacagtcttacaaggttcagtgcttagagagactgccgacaagagatcccatttaaagcggaggccatgcttaatgaacaacgaaatatggccccatggggtagggttgaaagggaaggtcctaggtctcttgtatgctcaaaataaggtctaagatggcttatggggtccaaaatctcagtatggcttcaatgcatcccttacaaattgtgggcaaaaattgcaaatggacatgttaagaaggtgatgaaatttatcaaaacaaattatttgaaagccaaggccaatagggagcttccagagcagcacctccagtcatcaggtcacagaacacaatcaacaccaattcccatgggttcactttcatgctgaaatcatgcctccccctctatgtgctatccgaggatcactgtgtttcctacagggagctctttcctgtaacctcccagactcatgagcttgtgctgagataacttttaaaattgaatacttactgagtatttattgaaagctggtttcttttaagtttgctacaaccaatacaaaaatcaaatgggcatcaattccttgtagagcaatgtttactcttgttagaaaggaggtgccattagtaagataacataggtattattttactagaaataaaataattgtaataaatgacatgggtgtgtttcattgcaattaggtttaatcatgttttctcactgtaataaagaagcacctgagtcgacatggaaggcgtgattgagttttcaccattgccctaaaatagtgggtgtgtatctccattatcttcaagtcactttcaggttaaaaccatcccagagtatttggtgcagatttacatgttaactagttcctcagagagaggggatgtgagcagtcttaaagaatatgccatctggtgcagtacgacttcccggtaacagtttatctaaatgtcatcattttgtttttcccacacatgccttaatcaccttcttcaggaataaattgactctcttgtcatatatgcttttccatggtttctacacagtacagctctaaatgcttattgccctttacaggttgtactcctgaggtctttccttatttcttggcttccatatttgacgcaatctcctgtaaagtctttgagataaagtctcagtcagtgtaagagagaaggaaacaggcacctgcaagtgctgaatggtgacccaggcagaactcgtgctctaccctagaggcacccaccgtggaaggctgcttttctagcatgaggtaaaacttcagggacgggtgcggtgtctctcgcctgtaatcccagcactttgggaggccgaggcgggcggatcacgaggtcaggagatcgagaccatcctggctaacatggtgaaaccccgtctcttctaaaaatacaaaaaattagccgggcatggtggcgggcgcctgtagtcccagctactcgggaggctgaggcaggagaatgacatgaacccaggaggcatagcttgcagtaagccaagattgcgccactgcattccagcctgggcgagagagcaagactctgtctcaaaaaaaaaaaaaagaaaagaaaaaaagaaaaaacttcagaaagctggcttggggaagcatttccagaacgtgatcatagaatcctagcaactagggaaagatgagtcactgtgaggaggttgagtctgaagatacaaagcttcgaatttatcaccctgcattccacaaacaaccacagcatatgctttctccactgtttctcattttggtcactagagcacctgttctatggattgagcaagatgccagggagtgtcatctccctcttcctcatgaagcccccaccaccaccgcatccagtagtcaccgaatcgtgtacatcaagcctcctaaatatcttttaagtggacctatttccctcccactcccctatcaccactgtaaatgtcgccactgtagtggtctccttgcgtctgatcgctccttgctgcaatccattctccacgttgcagaagggatagtttgtaaaattcccatcaatgcataccagtgactgtggaatggacattagccagatccagcattttcagtcctttggctgctgcaaactttcttaaatcacactcctttcaacatgcagctccctctgcctggaatagccttcccctctgtctacctaggccttctcccttctgcgggtgtccagagaatggtcctcctttgtaaggtcttccttgaagtcccctgcttaccaccgtcctgctctgtgctccagatccttctctattttcccttccacagccctcctgccacttcactgtagtcatgttgcaactacccatcttctttggcacgaaggaagttctgacaggtttcacagccatgtctgtcttctccgtcactgtattctcagtacctattatagagtaaatgcttaaaaacataggatgaagaaaaagtggatctacaactagggacaaatttacaatgaggcaaccccaaggatgcttatcagaactctgcagattcaacagtgaaaatggcaggcatgataaatcaatgacttaaaaagagaagggagtttacataatctgcaagcactgagcaattctggccaagcagagggtatgggtgggtacaaggtggtgctttctactactcaccaggacagcatcactacaaggggaaggcaggtgtccacaggggtgaagaaaagagcaggatgagaggaggaatttggaaagttcacttttacatttcttctatggtccgctaagtacccattgcctgacacttagtaggcatccaacataaaattattattattattattattattattattttgagacagagttttgctcttgttgcccaggctggagtgcaatggcatgatctcggctcactgcaacctccacctaccgggttcaagtgattcgcctgtctcagcctcccgagtagctgggattacaggcgcacaccaccacgcccggctaatttttgtatttttagtagagacaggttttcatcatattggtcaggctggtctcgaacccctgacctcaggtgatccacccaccttggcctcccaaagtgctgggattacaggcatgagccaccatgcccggccccaacataaaattatttaatgagtggatataggttctacagcctcagagcccctgcaataccacagtattagactatccatatgtacccaaagtttatcattgtaatactctaaactctgtaagaagcctcagaatttcatcttaaagttgagtttctgagttagaccactggcaaatcagctgctctcactagatagtttttctccaaaccactcattcattaattcaagaaacatgtattgagaacctaccatatgccaccccctcttctaggaaatggggagacattactgaacaagacaaggtgcctccaatcatgaacgctattggagaagagagaaaacaaaaagtatataaactagaaagaatattatttcaagtaataggagggagaaaggaactaaacgcagaggaaaaagcaacagattttacatggggatagaatgtctagggaaggactctctggtgaggcaacctccaaggggccacgacggtggaaaaattaattccagggaatctggaaagaacattaaaagaaatagccttaagattgaaagccatgccattttaactcccgtggcatctggcacaacgcccagcccagaagtctcacctattcactcattcaatcttctgttcatttacgacctcattcattccttctacaaagggtcagtgaggattcacagcacaccaagcactgtgttagacagtaataatacaacaaacgtttattgctttattgggagaattagtgtgtatttgaacacattaaaacctccagtatttgacagattttgacatacaaatggcaacttcatgtaattcatagatgctatttatttctagattggtaagcacaaactattgggaagtaaataacgcattttggaaacttgatttttcaagttctttgtaagaactcttttacatagcattgtaaaagatattttacattgtacttttagttgcaaaggagttttataaacgggttatagcaaactttttaaggaactatataagttcctttaaggaactatttgtcaaccttattccatttacagctaatagttgaaacaaatgaaattgcattttcttaaaacatattatatttctaatccttctcccaagttaatgcaaatttagaaaattttgcatgtattggtatatatcacaattcccttcatttacctcccaattagaatttcagcctaaggctacctttgtaatttctcaatagagaaatgttttaaaatataatttcagataattcaaggaactgagttaaacaagtttggagcatatttttggtgacaactattggacatacgaattgtcaccaactgaaccatggtccattcggcctgccatgcccattccagaagatacccgagaagtcattgttgtcttaggccattcaaattttcgtttgcatctgtggccgtgagtatcacacactgtgtttcctgatatctagtgtaccagaaattttctgaattttccagtagtcattaatggctctttaattcatatactcattcaaaccctatggaattcatttacaatgaatcattataatatattctttaactcttggagtgatgaattttataggtatatttacaacagtgctacatagtccttctacagcttgtcaaatgcacatcacattcaagagattttgtgatgtcataatgtgatgttcctcttatctctgttactcattttgatatggaattggaatatatcctgttcccagttcacactcccttaagttaaagagatacattctttttacaacagagccttatgttttcatctggctaattcagaaggtaattccaacggtgaaaactatctcgagtggtaattatttgggcagtatcatttcatgctactcagaatccaaggaaaagtctctgatatcctggagacagcagtcttgattaaagagcctgagaccacttagctctttcagaagacctctgtaacctgaaatattgtagtgtaatttgtgccccaggtataatctaaaagcaaagttaacattctaccacatggtgactaaacaaacttattgtatattttaaaattaaattaagactaggttttaagtgatctcaccacaaaaaaaagaaagataagtaaataaggtaatacatatgttaattagctggatttaatcattccacaagatgtacatgtatcaaaacagcatgttgaacactataaatatatataacttttgtcaattaaaaataaattaaataataatgaagatgaattcctgttaacaactagaaaacaaacaatttgagggcaagttatgataaataatagtatgtaacactaaggcagacaacattatcctgacaaaatatgatttgtcttcttctttacacagatatcttgttctcttttgaccagagacaaaagaagaaaagtcttggaaacatccttcacagtttggggatgaatgaaggcagagaagtattcatcagtcttatgttcctggcaatgaaagtcaaaggaagtcaaaattgtggcttctagaaaagagaggagctgacatagccccagctccacctcccttgtctcaaagcataagagcataactgattattctcaacctcatccatacataaaaaagcgtgctaaacatttacttttgtatgactttagcaacaatcaaaataacttcataattttgcatttcctttttattatatataacatcatattttactatgtgtttccatatacctaacccttagatcctcctaagccctctgaatgggaagcaaaataggtatcgttacttttcaaatgaagaagccagagctcagtgcatagcagggacttgtctaaagtgatgtgggtaggaagtggtgaatccaaaagctgaagttctggtcttctaactcataatccggtgttattttcctttctatctttttttttctttttttaagatcagatgttcatagtaactgagcagtctctcagtgcacatggagtggttttaaaagtcaacattaatgttcaattctgctgcacggtgttgagtattctggaaagatctcaagaagagcctgatcccatgccagcagaggctctgttatgcatcctgcttttccttttaaggcattttaaattaaaggaagccttagacaccaccatttctttctgtcccactgacaaccaaatcctttcaacgaaagcaccaatttggtttagctacagattatttttatctgttcttgaaagtcacataaacgtgacctgaacaaatacgctcccctgcatgttcttcctgaatttcaaagtttttcagtaattaagcatttttcctagagtgttgcaaaccaaatagagttctgtgccaaagcaaggaacgcattaatgaaaacgaagaataaaaggaagccaaatccaagttgcaaaaaatgctctgccttattttgctgaaatgagatgcaaatatatatatataatatatatatatatatatgcaagctgaggactagagtaaatataatatgttgatgtgaattttcatactaaaatttttcaagaaaataaatatcccatctcaagatatgtttttttaaaaagaatcacacaatcacatgaattaaatgtgtgtcttggtaaatttagggatgttaataattcattccgataatagtattaaaccagaaaactttacagagtgaaaaagtaataatctagcaaagaatcctatcattggatttcacccaaaaaggcatcaaatcctctagattccatcaaatttctttaaaaggaaaaacactttttcttttcaggatgtcttagaagttttcattaaatcaaaaatgtgcacagcttatacagtggttctccagaaaacttcaaccacttggaacacatgtttgtgtttaggggaagacagagggaaaagagaggaaaggttgggaagaaagagatcataatggcttcaacaaaatttacaaccagtgattgtatgatattgtggcggcggcagctcctcacacaaaacagatggtacaatacagagctgtgtcttaaaatgccaagcaactaaagattcactgattccatctacttctgaagcctttcctaacaatctatgccccagagtcgacttcagaatatttttacgttttaattatccccttatttgaattactatagcaattatagcttcatacaggctcattatacatttaaacattaattttatgttttaaaactcaatactcttaggtcaaaagctcactagtgagatagtggagtggaacgttagtttcctatgtaacaaatgaccactgtaacaaattcccataaacttagtgccttaaaacaactcatatttattctcttgcatttctggaggtaagaaatctaaaacgagtttccttgggacaaaatcaagacctcagcgaggccctgctccctctggaggctatagaggagaatctgtttccttccttgccttttccagcttctagagctgcttgcctccctgggctagggcttcccttccatctacaagggaggagcagggcatctccaattctctctctgctccatcttcacatcgccttttcctctctatctgcagcaaatcttcctctgctccctcttataaggactctcacgattacatttaagacccacatggacaatgcagaataatctctcacctcaagacccgtaacttaatcacatctgcatcattccttttgccatgtcaggtaacattcacaacttccagggattaggacagggacgtctttggagtggactatcacaccctccacagcagcagaggttaacctcttaatgtcaatcatttagaactacagtcatccttcagtatacctgagggattggttccaagacccttccccataccaaaatccacagatgctcatgtccctgatatgtaatagtgtagcatttccatataacctatgcatatcctcccatgtactttaaattatctctagattacttacaatccctaatacaatataaatgctaagtaaatagttgttatactgtattgcttaggaaataacaagaaaaagtctgtacatgttcagtacagatagaaccacccttttattcccaaatatatttgatccacaggtggctgaatccatagacttggaacccatggatatggagagtcaactgttacttttaaatcaccttgcaaatgaaaatatgcttgctaaggttccttcaaaaagatcattcttaaaaagagttttggttagtgtagattccactcaaacttaatcctcagctccatgcatcattaaccttatggataaaaaattgtggggtgggatcctgcaattctctcgttctgtcaacagagaatactaaaaagtttaaagccatgttcctcaaaatgtttttctcctacacttaaatcgtattttcataacagcatttaatatactaaactacatcatagcctagcctagcctattctaagcatgctcaaaacattcccatgagcctacagttgcaaaaatcatttggcaactcagtccactgtagagtattggacatttacccttgtgatcaagtggctgacggagctgtgactgatggccactgcccagcatggtaagagagtgtccaccatatatcactaggctgagagaagatcaaaattcaaaatttaaagtacagctcctactgaatgtatatcatgttagcaccatcatgaagtcaaaaactgtaagtccaaccatctgaaggcagggaccatctctagttcgtcatgcaacggaaacttaaaaatgcctttaaaagttaacatagggcagcttaatttgacgttaagaaattttcattgagaaccttgaaataagtgtgaaaaatgcatgtgtaatatggttatggcaataggggagttggcaaagaacttgggagaacgtgcaatgttcccaattaattttagaccccataagaatgacacaaacagaagagcttgcagctgctaacaaatgacagatatgttctgtcacaccccggccagtccaaagggtaatgcagctaacctgatagtccccgggaatagcagctgtcaggaaggtgctgctacatgtcagatccagctccttaagagcaactgataagaaaaagatgaagaagaaaacagcttaatgtcagtgtaaaatctgaaattcacttaatcatgggattttaatttgttaaccttcccaaaaaatagtatgctaagaaccaaactgtgttccctagtcaaggtggagacccataggacatctcacttctccatcaactgccacccacgtagcacctcataaatgaaagtgggacagggacacttttctcttattaaatcattttctcatatctgaatatagttacgacatttgtgaaatcagtgcaaaaacaatctctttttattgaacgaaacatagcccaggtaccatgtgcttaattcaatttaactgaacaaatttactgaacacctacggtatataaagcactgtgcaaggcactgctgagtccaatgtgaaccctgcctttacagaggtgtgcagacatgcacacacacatacacagacacactcacatgacatacatacctctgcacacgtatacaccacacacagacacagatacgcaaacaccacgcaacacataaatacacacgtatacacacacaccacacacacacctgctgtccatgaagagcaggagttttgcccatcacatggagaacagggaacgtacacatggcaaggatttcatagcaccgttggaagcagcacttagaatctctagaaaaagagatttctcttatttaccatttctacactctctcacagtgaactacccgtatagtcagctgtgaaggttataacgcccactggacaaaattttaaaatgtagaaaactgtcttcactttagtatgaacaagagaatcctttgtcatcccaccccagggaaccagtgtgaagagacacgacagtttgtgtggagaaaggggttgaccatttacaaggagagagccatttcctaagacgttgcttcatcaaagcatcctggaaccccagaagagggaagagtatcaaaccgcatctgtgtgcaagaagcctggctcccctccccatgcaactggaagaccaatgagaatcagaaaagcagtgaccacgggccatcctggagccacatgggggcagcgtcttctgggacacaggggaagcactgagaggcatttaggaaccagggatccatggtcattcttacttaaagaacacacccattatttacatcctatcccaatggtggcaaaataataccactgagctgaaaaggatctctacattctaccaaatcctgttattctcacatgggcttcttcaaaagtatagaaggttgtcaatgtgaacacagtgcacttcatgactatcatatcaatccctgagtgtttactttcttctcagtgacattaacactggaacatccatgtcaaggaagtacgatctgttcttttcaaactaaaacatgtccagtccggagtgggtgggagcaagcccaccttgtggccactactgaactaccaaaactccaacagagaaaccaattctgtgaagcctatggggaatgccacattttttctaaagaaccataaattaagtttaaattcatgtggtctgttcactaaatgtctttgcagaaggaaaagggaattggctccaaggattgcagttgctctgaaagtgcatgtggcatcaatactcacttctctaagtggggtcccaggacctgtggcatcagtattatctggaaacagaaatgcagactctcaggttccacctcagaacccctggaccagcttctgcatctccacagaatccccaggtcctctgtgcctttaggttggagaatcagtggaataaacaccaggagtgcaaacaagatcaaagaagttacctgttgtagttcactttttcaaataattgactgaaattaatttttataattaatgaagctagtgatgatttggaatcccttgactaagagaagggttttaatgtaattaatctgcaaaatgatcagtttttgtgcatcactaaacctatgaagtttataaagattattttcctagctggttatgaagaaaataatgtcacaaaagcatctaagggctgtgccttaccaatgagccgaccctctccagtctgctttcctgtaatcatagtgactcaatttctagacttagaaagaaaaaacacagaaaactaacatagaggattgttctcccttctggtcacggtttatggtagcaacaggtgaaaaaggccaacagaagcaacgatttgcctcatcacattaaaagaaacatttgctttctcttccaaaagcgtaagtagtaactatggaaaccagacaaaaacgttgaaaatgacttgcaattcacaaagagcagaacaactctatttcacccaccaaaaaacaaaaaaattaacgatgaaaaaatccaccgaaaccttccccaagaagagctggatctgcagaagacataatgtgagtgctttgctcatgcaccatcataaattgtttgatttgctacagaattgttaaattatgtttttacaaatcggttatttagctgtgactccatttaaatctacaattttatgtgtcctgatgataaaatgggcccttagctgagccagctaattcctcaggtaaaaggcatattcttttggcagtaaattaactttggaaggtcagtaggtggcctatcaccaatgttagagatttaagaaatgcatattttgtctaaaacacttaatttacacctaaggaagctgaatgaatgatctcaaaatttccagctattatctgtttactaagttggtcctctggatatcctatttaaaggttgaaataaatgtacacatgatttatggagagaaaataaagcaggaaaacttcacccaattatgccaacctactcactgcccagaaatttccatccaattccactgccataagcaacttctctgtgtgttctcccatttatctgtttgatgttcctgtatccctcccccactttcagatcagatgttacttccttttcagacgagcttgtgcactgcttgatcttaatggaaccccataaggagaaaatgaccactttattttaaaaaacagaggagatgctgactcaaaacagaagagagtaaagaacttccttaaaaatatgaatctcagtgatacttttatagcccagaatgacatgtttatctttcacctattttttttttcactccaagcaagagcagaaaatttttttttaagcttgataagcaaagactcatttggggatacctgctacctgaattatcactatcagggttaaattaataactatggcatattataaagccataaatataattttgagctccactcttcccagcatatttatgtgagtttttgtctcattttgtgtgtttgtggtgagttttcttcctttctctgtaaaacatggagctgctaaggcatcagtctgttattgtatactgacggagtgtggaaataaatgccaatatcatttgcagagccatcctggttgtgacttttttttaggtgagtatcccactttcaactaaaacctagaaaaagaattctaaaacctttttcccaattaaatgttggcactcataacacattgttgatggattgaccaaattaaaaaacaaaaaatcttaagtttaatactgttttcttcagatggcatcaacagcgaagtatgtccctaaacttttcattgttcaatgctgggttgacaagcaagaaaaatctttttatcaccaaaatgcaaaaacaatctgaactagctgctgtgtccaatccagcttcgttttaatttggtgctaattctctaatttgctcatttattttctctaaccacataattaatgctgaagaaagtcttttacagcttgccactgagccctccatgtcttaatagaaggaaaaattccttagatatgtttcccatcaccatgcatgtgctgaagccaagaactagaaaaccgtaactgtgaagtattacgaaatccacacaattaagtgctgaaaccagcaagggccaaaaccactctgagacccagctcagaccaacccagcctgccctttcaagtctgtaaattggatcgcggtccagtgctttctcttacctcatcagccttcctttttccttttgctgtagtggtatgttttcaatgaactctgacatatttctctgattgaaaaccattttaatactcctagacaatgtgcttctgaaacattgtcacaacacatacaataaccaaaagtttagacctgtgtaaagcaaagtgaaaaatggagtgtcattgaatcccacaattctcgaaatacaagtttatgggaaaagccaaagagagccaagtgatatagtttccagccatggcacctcaggaaggcccctcacctggcctagcagcagccattcccacccccaaattgtaacctcagaggtacagaaccattctccaagtgctgtgacctttcctcctacaaatcattcatcagtccaacatttcctaagcacctactccaggccaggcactgttgtcaggactggacatacagtgaaggaagcaaaggctctgcctcgtgggacccacactccacgggaggaggtaaaccaccaaatacatgagtaaacctatggaggatgatggagaagagaacagaggaatggcgtgctgggaatagggcagggagggagtcgctgaaatggagtgaggggaacgtgagcctcttgaaggacagggcactggggcggagtcagaggggcttagaaggtgagggtgggtagggggaggacaggagctcagagcagggaggtgggagagcaggcactgctcaccagcatctgggcctattgaagatagggattggtctgggattggtctgttattccatattttatactctcccagccaggagatcaaagtcagtggcatcactggtaagtcctgtccatagcactcatccttgatatcatgatgatggcgctttatttctgtttccctccagaaaatcctagctccaggcaagtcatgagaaaaacctcagacacagccaaactgaggacatttgacaaactacctgatcagtcctcctgaaaaccatcaaggtcatccaaaacaaggaaagtctgagaaactgtcacagccaagagaagcctaaggagacaggcagctaactgcaatggagggtcctgcacaggatcctggcacagacaatggacatgagggaaaaagtgaggaagtcagaatagagcgtggccttcagtgagtaatgatgcatcagtgtcgcacattagctgtggccaatgtacacacaagtgcaaggcgttagcaataggggaacctgggcacagagtgcataggaactctccaaactgactttacaacttttctgggcatctaagactattctagaacattttttaggctaggcctggtggctcacacctgtaatcccagcactttgggaggctgaggcaggcagatcatttgaggtcaggagttcgagaccagcctggccaacatggcgaaaccccatctctactaaaatttaaaaaattagccgggcgtggtggcgcacgcctgcaaccccagctgctcgggaggctgaggtaggagaatcacttgaacccaggaggtggaggccgcagtgagcggagatcacgccactgcattccagcctgggcaacagagtgagatactgtcttaaaaaaataaaaataataaaaataaaatgaaatgtctttaaaagtttatcttgttaaaaaaagatgcaaatgctctctatctagaaataatgattccagaataaaaactgcaacaaacaaaaaaggtggatgtgaaacaactgtacaggtgaatgagtcaggatttaacaccgctcggtctattcctgctgagcggtttatgaaatctgctggagccctcacagctggccattccatttatttgaaactctgaatgattatgtttttccctattggtcccagctctttcttccagggccacacactacaaggaaaacctcctttcctgtcagcagtgcctcaagtcctcagagagagctttcctaataaagcacgcgctccctgcagccgtgttctgagcctcccttcaccccacaaatcatgcctggtctgactccaaggaggtgacctagacaccttacagggaggaggggcagagaggacagcacctgctcagttcaggctgcctgtcacacctgtcctcaggatcctccctccctctctttaggggtccagggtgccactgagaggctccacctgatttctgaggtccaagaccgtcctgggttccaaaacagggtctcagacagcctccccgtcgcatagccttcgcctgcatggattgaacttagcagccctttcttcttccctcctctgttacctccacagcctgacaccatggtgacacccacacatgactcaagaaaggatgttgacaacttccatgtagaaaggcaagatcgggctaatgtaataaataatctcataccttggaagcagtcagcctgcacgtacgagacagagaaaatgaggcagagacaaagggcgtaattgcaaataagaggagaagtaggaggggaacggtggctcacacctgtaatcccagcactttgggaggctaagatgggcagatcacctgaggtcaggagtccgagaacagcctggccaacatggtgaaaccctgtctctactaaaaatacaaacatttgctgggcatggtgctgcgtgcctctaatctcagctactcaggaggctgaggcaggagaatcgcttaggaggcagaggttgtggtgagccgagattgcgccattgcactccagcctgggcaacaagagcaaaactccatctcaaaaaaaataaataaataaaaaggaggggtaaagagtatgtctctttactctcctgtatgtgtttaactccacgccctccaaaatgaatgattttaacctggaaagttaaaccaaacatttgaggcccaccataactatggaactaacaatatttaaaggaatttgaaatttaccaaatttggtctccaatgacaagtatgattctgcatctcctgttgacatggaacatttcagttcatgagagaactggtcttcaactgaaattgaatgcacacagccttttatgcactgagatagacgtggcttcccttctcatagctcttcataatgttattaaacagtttctctagggccatttttacttctctaaatgatgacgcacatacatattttgagtttctgtggtctctttttttaacaagataaagcaagtagtaagtaataaaggtggtttcatgtacacagctaataagagtgtttaaaacctaatatcagctgaagaaatcttttccttatttatgtaaaatgggaattaactcatccagtcaagaggaaaatgaaatcaacaaatgaaacgtacacaagagaactgtaataattgccaaactcagctccgcagagaacaatgggattccagcagaacacagcacccgggcaatggcggaatgtgtgcatcgttgcctccttttccagagccttatcctatcacagccctgttagagatgtaagctcctggtctctctttgaagggtgtggtttcagtatctaaagtgattatcttacttaggttcatgaatcccataaaaatgcaggaattgtaaacatttaaagtgaaaatccttcctaggatgtctcatatcttagctataattgcaaccactccatattgtgtaaaattgtttacaaaaattcaaaaagccaaacaattaaacatattctaagtgtctctcaattgccatacaaatctataacgagggacaaagggaaggtgacatgactcagagtctcagcagtgagtcatcaatcatggcaaaataatcaccctcctgggtgaactctctttgtcaacagttggtctggaggaggaggcatacaggcatacaaaaatcagcaagttcttaaaagcatgcaaaaactgaattctctggacaaggtccagtgcaaataagttgggatgatcctcaggagcagaaaacaactctgtcaacaaggtgccacctccaggtcatcctctgtgctccgctcccttacagatggtgtacagggtcaattagtgtctgtcccctaaaagttcacgtccacttagaacctcagtgttatgttatcactatgttatagagcttttgcaaatagagttaaattaagatgaggtctaatatgctttaggttctgtgtccccacccaaatctcatgtcaaatcataatccccacatgttgaaggagaggcctggtgggaggtgattggatcatggggtggtttctaatggtttagcaccatccccctagtgcagtgttgtgatggagttctcacgaaatctggttgttgaaaagtatagttcttctccctttgagttgtctctcctgcctctatgtggaaaagagtgcttgcttctccttcaccttctgccatgactgtaagtttcctgaggcctccccagccatgcggaactatgagtcaactaaacatcttttcttcatgaattacccagtctcaggcagttatttaaagcaatgtgagaacggactaatacaagatcatactggattagagtgagccctaatgcaatgactggggtcttcataaaacggccacatgaaggcagagacacacagggagcactccacgtgactactgacatagacactccacactggaatgatgcttctacaagccaagaaatgccatgaactgccagcaattacaggaagctgaagatagacctggaatatactgtctctcggagccctttgaaccaatctgctaacaacttgatttcagacttctggcctccagaacttcaagagaataacttctcttgctttaagccaccgagtgtgtgctgatttgttatagtagccctaagaagcaaatacagatggtaacaatgaccacaaaaataatgatgaaagtccccttggtcacaatatcagtccttagctaattttcaaccattattaatgcaaaataaatatatacataaacactttttttgggtgacttgacaaatatttaatgaactattagttttcttcccatgaagggatttgagtgagggtcctgcctcacagtcatatactaaccatatatctattgaatgcccaaaatttgacactttggcttagataccatggcaggctaaaatcaagctaataaaaaagagagagaggaaaaaagagatttcagaggatactaatatttacaacaaagtttacaacctgttgtttgaatcatatgaaattgccaatagttgacctttcttgaactacaaaaatagctatttcatatggtttaggccaaaggttgaacactatggccataagccaaatctggcccactgcttctttatgtaaataaagtttcattggaacacagtcatgtcatatgtttgcatagtctcaatggttgttttcacgctacaacagcagaactgagtagtcatgacagagaccatataaccctagaagcccaacatacttattatttcaccttttacaagaaaactttgctgatccctgatttaacctaaaatgactggcagcaacagtaaaggcaccaggatttcagaagaagccaagatcaatgtaaaaggaatccttactagtgtgtccatctgagactccagacataaactgggacttgagaaagaagctgaattctaatgaagaaaaaaggctctcaatgcaacagttcaagctaaggacagaagggacaaggacccaggggatggcgaggatgataatggctgtactggcctttggccccaaataccaggagcacttgtctctcggagccttttcaaccaatctgctaacaccttgatttcagacttctggcctccagaacttcaatcactgggacacctcaaaatgcccccatttggttccaggtcctgtccctgctaaaatcctcacatgaagtagaactagaatgagaaaactttgataaggtttcagagatcaaaattctttgaacaccagactgagaaattgtatctttttttctttacgcatgaatcaatagaaggatatgtaaacagcatgatagaagagttatattaggaaaattaatttctgatagatgtgaaataattgagtctagagcaaaaactatattattcagaatatctattcctgtggccctttttagggttgtatgataaaggataattactccaatgattgcagtaattacactttaaagatttatagagagttctagagttgggaatccctttggggttattatcaaatagaaaagtaatcaaaaggagccttttctgcttcattaataggccacacattacagccaaaacataacctgctataaagcttgcattgtacatcgagctgcaaagtcttactaccaaatgcttcccagggatttataaatattgaaaggtagagaagaatttgcttgagtgaggaaagttctcctcttttccatttacttcaattatccaaaagcatattaaaaacatttaagtttaacattaaactagaaagccaagtgggatgtgttgtaagtaaattaatagctaaatagatatgtgcatgtttatcaacctgacattaaatgtatcttaaaccacatatataagagctgtcacagggtcatacagttcattgattttttcaaaactaattcacaggtacctttaattatgtaaaccagctgttcactgcctggtaaagacttcagcttgcaaagtaagaattatctacttagagagactgacctagaacacagttgctcccaattttttaaaggaaatggtgttacactgcagcaatttcttctcatgaacttgttagctatgagcccttgagccatcagcaactgaaggtccggagaagccccggagcagcttggcttcagctgtacattcacgtcccctagttcacattttgctggtggccagtgagacagggcctgcaggcaatgctcagagggtcaggatgctggaaattgccttagcactgtgggctttaggtgacaactcaagaactgggaaagctacccaccctactgggctgtcagtgacttcataagacaatgcatctacatagctcttgacatactcagtaaaagatgctggagtttttaacttctcaagctgttcccctttgcaatcacaaaaccaactgaaaattgatgttaatggtcattatcttggtgacagacatttcccagggtctcagaagggttgtatggcaaactccacctgggtatggtaaggggagtgtaagacggaaagtgtggatggaggccagggaaacacaagggatagtgcagcgacagggctagtcacagtgggctcagctatcaccttgaatcctgacagagtgggaggagtgagcacttaccaggtcccgagtgtgctgaggccttgggtggaaggatgcagccagacctaggagacccctcagagcacaagcccttctacctctcatcttctccatggcccccaagggaaaaagccaaccagaagcagagggctagcaagacttcaatgcagtccagagcctggaggaggctccagaggatctggaaggataagcagaagatgcccagcatacttctctttcttttttcctaccatcaagagatgtttgctcttatgcaaagtcaagcaacaattccaagccctggttttatttttagcaaattccaatttttcctctcatcttccttctcgctctctgtgtgggtgttcctgtgcaggtgaccaaacagaggtggcgattcaactgcattttgcaaagtgctttcaagtgaacaaagacattaaaccacacttcagcttgtaacaagaatttctatttcttgaatcatcacaaagtaatacttgctaacattatggagtgctcactatggaacaggcaatttacatgcattaacaatttctaatgttggcaaaacccctatgaggtaggaactattgctatcattttagaattggacaaagtggggcatggagagattgagcatgttcctcaggtcctcacagctaccaaggggcaggactgagcttcaaagcctgcaacctggatccaaaatctgctcatctaaccactacctttatactgcctcaaaattacagtgaaaaggcctagaagatcttgatatttaaagacatcctgcaactaatcttcttcatagaataaaaatatctatttttatgaaacaatcacctattttgtaatttgtaaatatgacatttgcacgtagcatttccttatgtgtccatgtgtcagtttccaaacattgtctttatagaaatgaaatagaatatgatcaacttaggtaagttcccactgcctaccaaagacttcagcttgcaaaatatgaatatctacttagtgagactgacctagaacacagttcatcccaattttctaaagaaaatggtgtcagccctcagttacactatagcaatttcttcccatggtctttttagcaacgaaccctcaagccatcagcaaccgaaggtccccaagaagtcctagggcagcctggcttcaggctacaagttcaggtccctgattacacatttatttttctgggttcctattcactaaacatgagaaatggggtgggagatggcattttccattatggcctcagcacagtctccccacccacaaattcttctgcagtgtgctttgccacttgcctgtccatgggcactctctccaaccccatgaatctgagccctaggactgctttgaccagtagaatacagtggaagtggtcctatgcctgtccttggcacagcctttaaagggcctagaaacgtccacttccagtatcgaagcccatgccttcccataaggacagagaggccatgtggcaggataccaggtgactgctactgcatgaggcccaaggagaaccactcagctgagcccagtccacccaaggaattgtgaaacataataacaaattgcaggtttaagtcactaaattatgggaaaattttctgtataccaatagatctccagaacaaatgagtttacctatttaatgcattttattttgggaagagggaaaaagataagagaactacattgtttgctcacattcccaggtagaacagtttcacctgggagccacgagtctctagatttcaggagaacctggctccagagaccaggcagggctttagggatagctggttcttaggtcatggtgattttatttgtaggactttgtacttacaagaaatccaaagagctaggcagaagagctgccttttctattctgaacccatggtagcactgtatccagatggttctggttatgaccacaagtcactccttccagttttgaaagcacaaccagctgtcagctccatcaaggtctgaggaactgccacccaactgtggccgtgtgctctagggatggtggccaagcctctggtgaaagggctacccacctgcacctgccagctttgcctctcaccatttccgccctgcatggctgaagcagaagtccccacagcctcctccccagctgccaggcttctcggcacctttcctagaggtcaggatcctacttggccagccctcgtgggcagcctgcccctgtgggaagccaagagcgtgacctgccctgcctggacacccaccagctgcacagctcctcccagtagcttccgggtatgggactgtggcctttatgtcatgctgagctacagagctgaaattactactaatatatttcaattaaaataaaataaaacatgtaatcttcatattccaggaatatttcagacattgacctataggcctctgccagccaacagtattaagacatctactaaactggggccagaattttttttccttcacattataaactagtaacatgctttcaaataccggactcctcctagtatttaaacccttataaaatccatgggtatatgaaagtaaatatgaacttagcttcctattgttcattcattctacgtgaagctcctcaagaagagggtgggggtaggaagtgtggaataaaaatcctttttggcaacctgagctattaccacattttctctccagtcttagaagactcagatcctcccttctttcatcttcccttgtatcattggacctgtagccctaggcatagttccctgaaacccaagtaccatcagatccgaaaggtgtcacgtggaaatagcctcaatacctggtgttcgacaaggctcagcagccagcacaggctctgaagagcaggcaaaggcaaggcagaggctgggaagccccagggaggtgtgcgggccgcgttaggatggacatttgtgcataactcttgccgctctgactctctgcctcctctggccatgttagatgcgaccatttccacagatacgttccacaagcaaagccagcaactgtttgctgtgttgagttataccatggagggacagatcatgtgttaaaaagaaaaaaaaatgtgcttacacatggttgcttgtgatgacagctgagttcagagatttccatcttgtatgatattcacatttttatatgtagtcttttgagattgcacagaatttgatggataattacagcataaatacatttatccaaattaaacatccaaaaagaaactacatgcaaatttataaactcttccagtctcaaccaacacactgaccaaataaataataaaatgttctttttttttattttaaagttatttgccaaaatgtatccccaaaccaggtgcttctctttcaggtttacataaaaggacaaaaggaagaaaacagaatagaagttaattattctggttcacaagcccttatgtaaggagaaatgattaattaattgcatttgcccacatcttgagaaatgcaaatagtctttggtattctgaccactcaactcagacctcagctgcactcaggatgcatctatagtgggcagtagaagcgaggagagatccttctccagagctcagaggctaatcaaggaatcttgacttgcacaatggaatcacctggaaaaggagctttccaggaaaccccaactcctatgctaaggagctacaaaatcggagggagagaggcgagaatgtgccgccagtcagcagggaagcctccttagaagtgagttataagcagcttcattacctgactgctctagctccaagtaccctcttcacatcttgaggcttttccattcccagaaaggtcagcctcctcttccttatcctgactgcaaagtgttttcaacactggaaaaggtcatcttgcaatgaagatgaataatgtgggttttgtccctaaaaaactccaggaagcatcttgcgtgggagtccttgtgagacctcgagcacatcagatatcaaggtctctgcatcaagcactctgaccagaaacagcccccagaacaaggtcctagagaggtgaccagctccaaacttctctatgatcctgaaaaggaagactgtaaatagttctatcttttctttggcactcttgagaccatttctggtcttcaggccacctacattcgtagggaactatatctgcagacaccatatcctggctttgtgtggtttgacagatgtggctgtgtaccctgagctggagggtcctctcagagccctgggcaagtaccaacagtgtatctgtgccagatgggcatgtacctttgaagcttccttcagccccagcaagtgaggaagctccctcagggcatgcagacacacaggactctttctgtcattcactgtcccacaccccactcttcctctctcctgctgtcactgcaattctgccctgaggttcctaggaaagcctcagggtttgattgaattgaacctgcaacattggttcaggtccttgaggcacgctggcaaaaaatggtatccatgccaggacaagggacacccaactggaaaacagataccgagagaggaaaaaccatctctagcctctacacactgtcttcccagggcagagcctagggtctgtcccagagaaagtttctagtaaatatcctgcttcatagaccaaatactaccatttaccctagtatctttgctggagcaagacacactaaaagcaaacaagtgatccaagttataatgggaccccatcataagcccctctctaagaagataatagatgaccatctctctatgaagtttagaaaaagacctacctgtggacaaagagataaattggaaaacctcagttgtgtcttccaggttctagaaatctatggaatgtttttatcaacctgaaggcagtcaatattcaatgaataaggcacaataattcaccaaatccatatccctttctttgactcaaatctatcctatctgccacatcagtttaggacaacagaaagtgtttgtcagaataaagatcttaaatatcccccccatcctcttatcaactacatattactttacaggtgaacaaaaaaccttggggaaaaacagtaatcaatgaacttttttttttttttgagacagagtctcgctctatcgcccaggctggagtacaatggtgtgatctcggctcactgcaacctccgcttcctgggttcaagcatttctcctgcctcagcctcccaagtagctgggattacaggtgcctgccaccatgcccagttaatttttttctttttttttttttttttttgtatttttagtagagacggggttttgccatgttggccagcctggtctcgaactcctgacctcaggtggtccacccacctcggcctcccaaagtgctgggattacaggcatgagccactgtgcccgacctgcatgtgtatttaataagaaggcatttctctagacatggggaaatgtaaatataattctttcaaagagaaatggtcatttgtctctccgatgattggggacgagtgttatcacagatcttttcacagagggcaactgtatcttccttttattttccacagataaaggttgccatgatagccaagccctttctccaccaggcttctcctttgacacttttttcatgtaaaccaaagagaagagtgaggggaaaaatctcagctgttctcctttatgctccctgccaatacaataaacatgtccttggtaggtattaatggtccttaccaccaaaagactgtcatcttctaatagcctgcaactgctcccaatttcatgcagtgttcactttgtcaagcacctaattccaaagcctccaacccccatgcttacaaatagaggttattcttttgttttctccaaagaatgaagcatcctttgaccaaagccatcaatcctagtgttagatttaggttgacaattgaaagatgttgaacacgccaattcgtctgagcccatgatactgtggtgtccaagataccatcactaattttggatcattggaaatattccaccacaggatacatttgaacttgttaaaaatagcccagctacccctctgaacatttcaacttactgtggcatcaacagagacatgctcctagttacaacattggcttgctcctctggaatgcaggaaaggagtcaaatttcatgatacggaattttcgagtttgtccataagatttttaaaatagacctttcactttagtgtaaaaggttacatacatagtaaaagattgtaaatatagaatttaatgtcttttctccaagtatgaacagaccatattgtatattttaggtataaaatattcatctaaaatattcagtatgaaacaattgatactattttcagaatactccctgtgcctccactctacttaaatatagagcatttaattaagtgaatccaattaatcatgtgaaagttaatgtgggaaaaggaaacagctaataaactcccaatggctcagagaagcaaagcatttcaaacatgcagactttacaagtttcctatgtgcctctaattatgtctttatacaaattcctttagctttctaccaattctgagaagtctaaggccaaattcttttctataaatatatctacaaaaactttttcttcccacacataggaaagacacaaaagatcgagtgagctggaacccgtggcccccttcctcatgggtttttaaaacatctgacataaactgcaacatatttgggccactgcaattatcaagcaaaaccgcaaaccagcagaagtcaaagtcaaccccaaaagctgtgttgaaaaagatacaccagcactcacctgaagaggaacaaagataaaagcgagtgaccctataaactttcaagaaagcagctttccctaacctgcttttgattagtgttcataggtttagccctgaaggcttaattaaacccagtagccaactctgtctcacttaaaagtgcaattaaagaatccacaaaggccactgggccctgagggcctcccacatgaggccccactatgagcaattcactaattgcgccctttgtcccccgactcttaatgatgacgctgccacacccccagtcaagatgcttattctccccacttagggccagctccaaaaacctcaaggcaggaagtgtgggcccaaaagcctgttctgcagagaacatacacttttaattaaacaacaacaaattaaaagctcattgaaaaacacttagcaacaaatccaaaactgcactaaagtccatgtgttaccaccactaattaaaaggactcttgattacagatcattgggtgtgatcttgtagccaggacttattaagggccatgatggagcccactctgaggggcaagccagccagtgttgcatccccatggaacatcatggtaccagaaagcggtcccgatccagaccccaagagagagttcttgcacctcgtgcaagaaagaattcaaggcgagtccataaagtgaaagcaagtttattaaaagcaaagaaataaaagaatggctactccacaggcacagcagtggcagtggcacgggcagcatggggcgggggttgtttagaattttatttggggtttacattgggcaagtcagtcttctcctctagccatagtccaagttcaaaacattgatttccttcagcctacctcaatagacaattcctcaatagatactctctttaaaaatgcctttcaggatttcaatggacagggcacataaccacagtgaagcctgactcttgtcctgacttgtgtaagacttcaggacctaaagtccaagcacctacattgactccttgaagttgtagagagcgacctgactgcaaagtcgggtcagggctgaatgaggtgtgagccccgggaaagcccttctgctcttcccacctcccagcttcatcctgaagatcctcgctgtgaatccttaagggctttcctatgcagcaagacaaacctcagggagctggaaactccgcaggtgggcctggaaaaactgttcaaagttaagtaacattcgcaggcgtaagctttcaagtgaatgaatctttgcgattcttacttgccagcttgcagtttcctgaatgatttcttttcgcaagctggtgatagaacctaggaattccatcactgctggcagacggaaagtaaatttggctccaggcctgactttcggagtcagcgtggaaagctgcaacagccaagatgggctgcctggacacgctgagatgctctctctatatggggcccctccttcccaactctcacctccactctcccaacccacccacgaccgctacacaattgacattcagtgtgacattcttaggtgaagaaagctttagaaaaaaatactagtttaaagtatgtgttgtttaaaaaaaaaatgcagggaggagtggatcggcagagtgggaatactttcaactcaaccacctgggttgggttcaggtcttcccacttgctcagcaccacctttgaggagtaaggaggcgaaggaagtgagagtgattcaaagatggaaaagaggggggcctttaagaagcatagcctggaaactccagatttttcccaccaggaaccaggaatgaagaagggagggaatctctactgccctgcggcaagccaggagagagttaccccacgggcagatgctggatcttcccaagctcaagagcaccgtccagtgtgatgcagacgtcgggatgtaactgaatagccatacgtgcctgtcatactcagaactgacttagatgtggtcctgtctataggcgccaacatgaaaccacccaggaacaagactaggagaaaaaggacacgtgctcctgctcctgtcatagcagcagcagcttgaatcccacagcaaagtggccagatgcttacagacacctgataatatcagacacagagcacaaaacttggtgcacccacttttacatgggtttgggggaggacggtttggctcaaaactttctggtgaacaaagagcataataattaaaattattttggtttagcagagaaattaaccagaggacgacaatcataaggagggggaaaaggaaaattcctctgatagatgggggaaaagtcactaaagggtatctgaagagcagccctatgcaaaaagacaggaggccaggcacagtggctgatgcctataatcccagcatttcgggaggccaaggtgggtggatcacttcagctcaggagttcgagaccagcctgaccaacatggtgaaaccctgtctctactaaaaatacaaaaattagctgggcatgatggtgcatgcttgtattcccagctacttgggaggctgaggcaggagaatcacttgaacccgggaggcagaggttacagtgagccgagatcgcaccactgcactccagcctggagaacagaacaagactccgtctcaaaaaagaaaaaaaaaaaaagacaggaaactgcagtctaggatttccctttccagtttagatcacccagacaccctgtcctgggcaaaggctcaataatatctggacaatggacccctgctctgtaaaacaccatttttcttttctatttacagcctggaaatattaaacttaaataaaatgtctatctttaactcctaggctcaagcttcaatgaagtttctcttcactgacactggcaaagatattctgattttaaacttcagaacagtgacaggaggacaggaggtgccgcagacacaaggcattggacatgggcaccctgccaggctgtgaagtgaacattcgaggcccttccctagcttctaacctgtcagaataaggttaaaatcccatacatcttagagtgtccaaaatcaatattagaggctaacatttggatgcttttcaaaaaagaaaatggttagaaaaagtagaaatcattaaaaaaaatggtctaatacattttatccacttaggacaatgccttcacataattctatacataacactatgagctgctttaattatgatcaactgaagctaccggaaccaatacaaatctatgattaaaggagattttaaaataagggaaaattaccttgctttcttaatccttctgtttcaaaactaaatacctgccctggtaacacagacatttttccaatcttgtaaccagccagtctgtttaactgaatggctaattagttatccttgaaatctagagaacattagcttgttgaaaatgaaagaaaaccaaaccacaaaaagtacctacctaaacagtattttattgactaactgaaaccatcaaaagtggtatgaaagataaaaatgtcacccaccccactgccatctaatcagcagaaggaaatattagtgtatcctcataaataactccttaccactcatgaagggtgataatttaggattggtaatagaaaaacatggtcgttctgtaaatgttactcttaatttgcttgtaagctaggcttcatgtttggaaagaggcaagttcaaagtgagctggtcagaaatgaccctggcaaaaggtcaataaagctattgcactaggacttaaaacgctgttgatctccatttttgtgaacaagtaactagaaatactgaagaaattaggcactatgaaaatgcttgcctgaagcatcacagggctggataaaaaaatactctattaccagtggagaaatgcatatgagtgctaaaggccagctagcctggaccacatccccaaagccatgctgagtgtatctggaccatggaccacctgtgccaaagtaaacactcccatggaaagccactatgtggaaaccaactggtgtgaggaaagcaaggtgcccacaagagagctgaggaagcctgtggcaggaggcagagaggattttaatacactaaacagatggaaggtgcagtaaacaaggtgggagagctaaagacactcacttctacccagagaaaacagtggaagagcaaggaaatgagaggcaattcgtatgtatctctacccaaaacctatattcagcattacattttaactgcaaaatgtgccaaagcagaatggaaagagctagaagcaattctttgattcttctctaagagcggggcggggggaggtgcgcggggtgggaaacactcccctttaaatactcaggctctgggcatttaaaactctgcattctgccactgggtctggctgttagaagttacctgccactccagctgaagcgaaggccttgctaagaaagtgtacaaggacacagaagcaggcatcatgaacttctcccccatcaaaggacagcaacctcatttgttgagcagaatgatgctaggagttccagactctgcagctctaatgagaccacaagattctgtgttgtcaaagatgttccccctgagctatgcccataaaacaataaaattggcagagaagcatactctaagcaatgactgggaattggggtgtacccaacattcagcggcgaggctggctgatgagtttaactgatttaatctggttatgttgtcgcatccggaaacaacctaagtttgcttgttttcataacagagatcacagctcagatagacttcccaggaagaaagtgtttcagtatcaaagaaatgtgctcatcctagcacccactggccctggcgctaagctttgtacaagtaatgtaaacacagaaaacatttcccagtagacgcagcaggactcgtatttaggccactggctgtttaatttactctaattttagagatgatgtccagaattttctttttaaaaaagttttattgaggtatatgttacatgccataaaatgtactctttgtaagtgtacaatttaatgatttttagtacatgtacagagttgtatgacaatctccacaattcagtttcttaccatttccatcacccccaaaaggcctaggctgcccatctgcagtcatgtccagttcccactgctagcccgaggcaaccactcacctgcctgccatctttatgggtttgccttttctgggcatctctataaatggaaatacatggtgtgtggtcttcagtgactggcttccttcacttggcacaaggttttgaggttcatacatattgcagcatatatcaagagttcatttgttttattgctgaatagtagcccattgtagggataggccacattttgtttacctattcttctgtttcaacttattaaatctataaatccaactacatgactaggcttattagtctgatcttggaaatataagaaaaagcctgccatatttttaaaatattctaggatgtctaaaatctctgtaatgtgtaaacatatgtaataaagacacaatatgttccctggaatttgtgtgcttggaggagagggtgctgttttaaatgagaacatccctgaatttcaatttttctgtgttttaatacagattaagtatcccttacccaaaatgcttgggaccagaagtatttcagatttgggattttctcagattttggaatatttgtattatatatattagcatttttagggtcatgtcggtgctcagaaagtttcagattttgaagcattgtggaattgggattttttgattaggaatattcaatctgtacacagaaattatatttatgctaatctccaagtcatgcaaggtcgtcaattcatttaacaagcactgacttactgtgcaaattgttgtgtattaggaactaggaaatatgcagtccctctcccaaccctccacctgccagtttacaaagacatttgtattttaagactgtgctaaaaaatcagtttggaggcatttggaacatttttctctaaataaagaatataagtagttttagagtccatggttagcccccaaaagtcttgcttaagccttagtcctttctctcagtatactctattgcagtctatactatatacatagtctctaagggcattttttgattcggtcacttacccaagatggcccgagagcctcctgcgtgccaggcactgttctaggcagcgtgggcaacacagctgcgaacaaaacagtctcattggtctcctaagctgacattctgtatcagtgaaagactttaagaaataaaggcagtgcgtggagttctgcaaaatgatatggagagaaggccgggcgcggtggctcacgcctgtaatcccagcactttgggaggccgaggcgggtggatcacgaggtcaggagatcgagaccatccaggctaacatggtgaaaccccgtctctactaaaaattcaaaaaaaaaaaaaaattagctgggcatgtggcggacacctgtagtcccagctgctcaggaggatgaggcataagaattgcttaaacctaggaggcagaggttgcagtgagccaagatcgcgccactgcaccccagccagggtgacagagcaagactctgtctcaaaaataagaaaaaaagaaaagaaaatcagtagttttacaacaaacctaaatctcagtcctgtaaaaggagtcacggaagccagttgtgattctaaaatccatttgtttacaggatgcccaaccataaatgtccctggcctccgaagcgttctctttccacagcaggtttgggggcactggcaggagtcagctgccttggtagctggctcagaacagctttgggggccctctgcaagacgtgtcacatctccggttttgttttgttttgtttttacagaaagaaaagctctttgtgtggaattttatttgaagtcactttgtgaggaatgccatctctgctgtgattcaggagaatagaagtttcggttttatgattttgcagacagatcacaggaaactgcttagcaaattttttcttagttgctttccttgactctgtttttctttccatgagtacatcatacatccttgccaaacattgggtggatttgaactgattgaaagaggctcgattttctgtgaacgatttgtccttgtgttatcctgattgtcactcgcctataacttacttaatttcacgtctcaacaaatatagtattatttcacccacagagttggcttctgatagaatcactctactggttatttatcatacatatctgtaattgaattacctattgcagtagtgtaatttactctcaattgtacataaaaatgtaacataaaataacatttttccagtgtatacttcctcattattctacatgaaccctagtttagccaattctacagaaatacagtgacaaataatgagtgaaagatgggaagataaaagattagtgggctcatgacctttcaataataaaagaatttcatcctctaaaaaaattattctcttttaaaatagttttttttccccaagtgttaatcaggaaaccaattctaggaaaccaataaggaaaaaaagagtttaaaaacagaatgattttcttttttccaaatgcagcaatactatgtcactacattttaaaatgtaggaaagggaaataaagtgtgcttgtctttgctcttgtcaaacaaccattaatcttggaccaaaaaagaagaaagaagatgacaacagcaattcctttgggaaatttttctgttttcttgatccactgttgtgtcactcctactttaaatttcatgcacaaggtgaaatatgacttgtctttgaagttgcctggcttcaaaatactctgtgaaatggacagcctggtttccttagctatacaaccttttagatggcaaagactgtcaatactagtatgttgaaataaattacctattatccaataccttctcttgggtcaagttttcatttgttttgttctattttgcttcaattttgaatcgaagcaagttttgagcaggttcatttatattgaaaagtttatgtatattctagcttactttaattttgctttttcttcttttctccctatcagaaattgattttgtatatctggataaccaattcttaaaaaattcatctgaaaaatatgctatatatttaccaagcgtacccatatctgtttctccaaagtgcttcccagcagccacatctcacctgctgaatttatccccaagttgctcccaatctatacaggaattggaaacaggagattgccccctatcatttctgcagggtagcagagtgataaaaacctaattttcaaccaaacttctgcatctcaattttaaaaggttgctgagaacatatgtgaaattatctatgttgtcaactgtactcaagacaactgaaagtacttatagacgctcattttatgattcaagaaaacagttaactttcttggtataaatttgcaagtagatgcaggtgagcagaaatgtacaatgcttcactttagacactttgtacttagttgtaactcaatttgttagacaccataatttacattttaaacattatttaacacataaaaacttgtcaccttggtataattataccccaagcaatttgtctgggtaactatagcaacaattgcagaaacatttttaaatacaaaattggtataattttagaatcaagaattatggaggatttattgcaggatgtacggctgctgtactcaaatagttgtacatatactactataaaaatggattccttgactgggatatgttataaactcatttgttctatcttgcacaccatctgctttgtagctcaaacctcttccttgggatgagtttttgatattagttaactctagggttcatgatcacttgtctacataatgcaatgcctttatactcttggctggacatttagtaaaggttttctgctcctcctccacatcttcctgtatcaaaagcaaaggctcaatttcaatgactttatgaccaaaaataaaatcacttgaaactcttaaaactaatcaccaagttaagtaaaactgtgtcacgattcagataggcagctctctctaacatcaggagcatctgacattgtccccaaagagctggcatctgttattttgggccactagcacacggtacagagaaaggcttgttggttgtaacatttgtccttcagcaagaggctaacatgactctggaactaaatttcttactgcaaatccatggacggggcttcagaaggcccatgactctaaaatttatgcagaagtttgtataaatgtgcttgtatttatttcggtctcgtggtcaataagttttaacagcctctgagctgtaagtttctacgtttcattctcccaagacacgtgatgaaatcattttaaagggaaacggcagtgaagaacgcaggtttatttttaccaaattctgaacgtctcaaaaatttcctctggacagagacaagctttaccacccaggaggccaaagctttactcgcagcagggatctcgcagctgtttgacattataacaaccaaatgagttagtgcaattcacaaaagacataaaatgattagcatcatctgtcttctccctgttaataaaagtacatattggctaaaagcacatagaaatagatgtcagtttgtcaaccccacacttcaatgagtatacagatgcttagtgtgactgcatggagcaacgtggatgagcaagcttctatctccaaagtttttacaagaaagaaactcaagggaaaaaacatctgtgtttcaagtgaaccaaacaattacacttagggctgtatttttcatgaaaaaaaaaaaaaaacatagaaaaagaaatcttttggaggggaaaaaaaaatccatgtttcttttggtgtaaatacaggcacagacaagaaaattatttcagttatacataacttaatggtattatctgcttgaactgaagttgtgtaaagtggtcatgataaacattacactctctaaaataatgaaactggcattaattagcaacaaattcagcaatcctaattaggtattgaaaaatctttcttattaaagcctggttttgtgtttctgtctccttatgaacagactacctctataattaataacatatctgctgattccaaactcagccattatgacagagctcttctcggtaagctagacgtaaaacttgtctttcttcaaaacaaaccagaacaatcatttgtgactcctgatgtgttaactaaagtacccctaaaaagcagaacggtattaaacaaagctcacgttatcttccctcaatttcgatttctttctgagtaaatgtaacagtcacaaggaaggcagatgcccagacaaggaagactttacagcgatctttttctctggaagagacctttctagttagagcatttatgtctggccaccacctttcctgtcccctctcctagcaaggctgacagctctctatagccaccagatcagctcccccaacccccggcccccaaaatgaaattattgcaagatctgcctggttctgctgtttgttgcctgggactcccgcccactcgcccaggacccagcaactgcctgtggcgcctcgtcctccgagcgctcgctcgcagcgccccctgccgggaatcccgaggacgccgcaggcgcaggaaagttaaatcccaactccggccgcggcatcctggtacaaagcaagcaaagggcgaggaggtgaacgcgcttcccgccaaagccaggggaacagggatgtgaccgctccaagccaggcaccggccgccgcggggagcgagccgggggaatcactcctccacgaccgttcccacgcacatcttgggagaaaccattccctctggagcccgatctgcccgaaaccctggggtctgaaaccctgagccgcggtgtgcaaaatccgtggagcagcggagggatgcctggtgaaaggggctcgcctagctgcagcgcacctggctggtggttccccaggcctctgcatcccccgccttagtgtctttcattaaccaaggcgcttggcggagttgagcccaagtcccattgcctcccggttcccctgtaaggaaagcaggaaaacctgcccaagccggtggggctgcgaggtggccgctcccgaaccgccaagtcccgacctccgtgtcccctgcccccggctcgcggcagtgcgagcctggaggcgcgccgggggcgggcacagaccagtgtgcgcacctttccgggtgttgggcaggggtcccgtctcgcccaccgcgacactccggctccttacctctccatgctcagacctcggcacaggcgggtacacaaacttccagcccgtgcactagctcaactgtgggcgcccccggactgacggtcgtcctaatcctgtacgcgcaacccccgcccaggtgcctgctgatggatcccacccgagatcggcaccacccaccagccgaccgctgcagtccccgggtcccggccagcggcgcggcgcggcgcggcgcggtcaggggctcctgccaaggccacgcaggaatcgggcgggggtcgctcaccaggtgcgaggagcgctggtgccagtcatccagcgcctgggggccagagcggctccgaggatcctcttcagcacctggctagggaagtggaggcagcagctgcagccgccccctgccacttccccagagccgccccctactcgctgagttccagaatgggggcaccggcttgggggccacgagcacggtccccgagcgcgcggccaaccggtgggtgggcaggttcgcgcccagcagagacgaccctcgaggtggcaaagttgggtgtccaagccagctccgcggggcagtcctgggtgggagaagggagcgtcccgggatgagcgacactggccgggccgcccctgcacggggaaggtggagggccggggctgcagcgggccaagggccgcggctggcctgaggctgcgaagcccacccgcggcgggaaagcagcgctcgggagcgggctcagggagagcagccgccaccggcgccgccttcccggcaagtagatcggcgcggggcgagcgggcgcggagagcgcggggcggagagcgctgggcggggagcgggggacagcctgggcccacccccgccccgccccgcccctgccccgcccccgccgccgcgccgcctcctcctcctcctcctccccgccggggtgaaactcgagcgccccacccgcgcctgacctccccgagcccctccccgggccccgccccttcccggtacaggacccccaccttcgctcctgggagccccgctgcaccccaggagttccattccagcctccccagtgcgagtgcggccgagcgctgacttttgggggctccctcccccgtctcactgggtccctctgcggctcccccgcccgctgtcccggttcagacgtggctgcaccccggaggggggcgccggccgagacctgagacgtggcgctccctctctgccggcctcggcttcaggtacgtgcggttccctcggctaaatctggcccgggggatggggggcaggggccgtctggtcctccggaactcgaactttgtgattttgttctttctgtgtgacatcctcatccgttctgagggagaaactccttaaagaagacgagagagtcagtcgttgcgggttcttggaggagcactttgggggtgagactcccggctagttcgggtcgatttcagcgggattaagtcaaggaaatgaacaaatctgacgaatcagggaggccagagaaggcgtccccaggtagccacgctgagcgttaagagagaagtcccgtatggtcaaagtcattcgtccaattctgtgtcaattattccttgttgcacttttgcaggatccttgggccttactaagtactcaggtgaaaagttgataattgggaagcaagtaaagtacctttgaagacgtgtataattggacactttgttgcagttcttcagtttctggaggaggcggtggggggggagagggagggggtcagcctcgcgaaaagagcaaatggtaaagttataggagtataaggcataaaacttgggttgggagtcctgactggccttgagtggccctttcccactggatgggggtgcgggacagtatctctgggccctttttactcagtctgcgcctcagagggaggcttgaaggtcccctgcatgaggaaatgtgtgaattgccccctcctgaccgcagtgaggtagggacccccgcaaggacccacgttcacaccagcgcccttccagccagtggtggggtatggatgggcctcgctggtcctgggcatggtccggtgcgtccataagggttccattgagctcatccataaaacaaagaagctattgcaggctgcagggtgtcatagctcgcacagtagccatgcagacctaagaggacaatggaaatacaaattgctatcgatgtgtctttattttctagaacttttttttaaaataaaagaattaagtgaaagcaattccgaaggtttctatgaaagcccagcccatccccaaatgcccagtctctggcacgggtgatctggctgtcttgggtactcaggccttactgggatttcctttaagacctctgggaggaagtgtcagtagctgggcaggccttcttggcaagcattcctccctgggttgtggcgggggctcccggcctgctgtgtggcagctgcaggctcctggggacctgaaggaaaagcttaaccgttctcccttcccttgcttggcacttagagcactagttccattccagacattccgattatcttgcctacgtggcacagaggcctaggagcctccctgggaggaagaggcaggccaaggtcttgcctggctgcttctagggggaaagatgtagggaggaagctgccttatgcttggatctgcagcctttgcctggacctgtggagcctacgtggccagggtgagggagacagaaattagaacccaatgtattcagctaatcctcttcttgcctctgaacattgccgttaatacttgaaaagaaaaaaaaaaagcaaaaaaactcttggcatatagagctaagcagtgggaagaagatagctttctaaaccatgacccaataggtctgataacataacatttaactggataaattacataattttgtatatatgtaggggggagttgaattcagttttgctgtttacaggctgcaccaatgcattgttaaaagatgtatattttagtgataattgtgattaattacaaaataattgctaataagcaggtaaataaaccaaattataatttagagtgcatcctttgtttaaagtgaaatggatctaaattgaggatataattttgagttttaatctggggaaagttctttaacttttctgagctacagtctcttcacctggagcttagacacaccagcctggcaggggtatgtcagctgtctgcttgaaaggagaaagacagtaatctgtgtgaaatactcaccgagcacccaacatataagcaggctcttcataaagtcattttgaggtatccacaagtatttcttttttctaaacaaaatttctttgttttttgtttgttttgctttgcaaaggtcttgcttgctagaaagctatctgcattaagctgcttctcatcacattataaaactaaggatgatcatttttaaacaaacaaaagtatttagttatcttttcaaagtaaaatatagctttccctaaactgttttaggtgagccatgcacacaatgtgaaagaatgaagaaaccaacaaaacacttggtgaaaatgatgaattctggggcgctgattcatgtgacttgaaaaatgccatccatttcctgattcacctcaattctgttcggaactatgaaagatcatttatgtttctgcactaattgaccaattttgtcttgtctttacttccctccctagtgcttgaatttcagccacatccctaagctgccatctcagaccagaggaacagggaggggggctttctggaaagaacatcacctggaagaaatcaggacatgactgtgggccatgagtgaccttcaaaggaaagccgggtatctgtggtctttaagatgtggtaagattgtattaaaattatagaaaaaaacctcaatccagaaatcgtggcctcttgacatttacatcttaactgcattttcctaccaatgagatgcattacaatcatcctccataagtgttctctttttacccctgtttccattcttttagatccatgacatttaaaaactgaagaaatggaaagatcatctgatcaggcccatcagtctttttcctaatgctaaacattggtacaaagacgtgaagtttgatgtctcactaagattgcctagggctgctttattgctcacctacttcaaagtattgggaaaacatgattatgggtacaggtgatgctgtgttgcccccagacaggtttcttttgtcaggttcttttgatggattaggaacctacaagtggggagattttagggaaatagcccctccacttggatttcaccaaaacgtctttagggttctcttaccccaagaaacacgcattcctctttagtgtggcagcccactctattggcaaagttaagcagaccagttttactaaaaaggagccacccagaaacttagacagaaaatacttgaggcacagatgagaatgagcacaaatgtgcatagcaagtgcagtttcctggcccttaaactgaagggccaggtcagtctgctcctccaggcacagcctgggaccccatcatgtgccccactctgcagtctgagcttccactcaagtccaccagggcctgcctcacatatatatacaagacccaatgtcagagtctgcctctgcccatgtctggtcagagggttgcactttgccactgctacatgttcccagaggttggcacagcatgacctggacctcacctaacccaggcaaactctgctcatcttcgagctctctggaacccatttctcaagggagaaccacattcccccacctcacagccaagttcaaggaagcagcctggctaaagcaatgactcaaggataccagaagcagagcacgcatttaagaagatgcgctgactcgcaggagcagctgactcttcttaagaagagtttactgattcttctttcagtacgggccttttaataagatattgtattttacttcagctatgggtgcagacaattaaaggattctagaaatctgaaagtgttttgccttgtcctcttggttaaatttctggatatattgtctagcaactcaatttgcttaaacaaaattgttgtgtcaaaaaagcccaagtcatcttttataagtgtggtctggggagaagaaaaaaatgctaagtttaaaagatttttggaatatctgaagaaaatacagatagcttgtaatggagatgaagcctctggatggtttccagggtgttattttccgacattgagtcttgtatatatcttgaatgtctataagcaaagaatggctatactgtttttaaaaagatatgttttatacttattaaccaatgtcctctctattcctctgcctttgaaaatagagctttgggggaaaataagtacctttggaaatatgttttcaaaaataatattcatcctgcttagatttagaagcacagattactctgccttagtttacttcattatttaccagagagattaactcaaaataaccttgagttaatgaaaagatgattaagtgaaattaaacccaaaagtaaaatgtctcctgagcaaatccatagaaagaagagccatcaagcatccagtgggccctccatcaagtgttgtttcaggccctcctttccaatccattctcattaccataattcacagtgtcagtgtctctcacccaaactaccaacacctcctcttaccgtcttcctgactccagttccagtgatcattccccaatcagcagcatcacacccacccctcacacatacatcatcatcatcatcattaccgttaataacacagacctgattttatttgaattggaaactacttggctttaaaaaaaaaaactcccttgcagctaggtgaggccatagaactcagccataaccaataagatataagtggagtaggattctaagataggctttgtaaaagggggcagacaactaaatgggcatggtctttcctgtccttctctcctacttctggattcccacctggaagttgattgtgatggtggaaataccaggcactggtcgggtgcgatggctcatgcctgtaatcccagcactttgggaggtcaaggtgagtagatcacctgaggtcaggggtttgagaccagcctgaccaacatggtgaaaccctgtctctactaaaaatacaaaaattagcctggcatggtgacacgcacctgtagtcccagctactcgggaggctgaggcaggagaatctcttgaactggggaggaggaggttgcaatgagccaagatcaggcacctgcactccagcctgggtgacagagtgagactctgtcccaaaacaaacaaacaaaaaatgaaatgccaggcaccagtttaggctcttgaggatataagttatgagccaaggatgatggtgtaaaaagtagcctaaatccctggtgactccatggagcccctgcctcagccctgaattacctaaccccagacttcatgacatgagaaagaaagaactttctgttttgctttagccatcattgtttctgttctgtttttagcaggagaatgtgattccttaccaatggaggggattcagttcctccaggtctggcaaccctgcagcttgggtccagtttcatccctcaacattgcggcctatgcagccagtgccccctctccctttctcccacccagctttcccatctgcaaccaagcttgttgcacaccatgtgccagacgcatggctgcacattcaaaatagaatgaaaagacacacaggcgatccctgccctttcagaagttacagcttaccgagttacagcttactgagttatggaacccacaagtatgtaattctaaaccctgataaatgctatgaaggacaaatatatgggtgtctggtttagtatggggaatgggagaggcatcactgaaaaagtagcatttgagatgagatttgaaggatgagtagagaccagcaagaaagtgggaaagataaaggataagagtaagactccagaaaagggtggaaatggagattaactttggaatttaattcaaacacacttgttaacatatcaaggattgtaatagtaattgcaaatgaatagcaataaatactgtcatagtccatttcaggctgctataacaaaaaaccttaaactcagtaatatataaacaatagaaatttatttataacagttctggaggctggaaagttcaagatcaaggcaccagcaggttcaatgtctggtgaaggcacagtctctgcttccaagatggtgccttgtttctgcatcctctagagaagaggaacactgtgtccacacatggctgaagagctggatggagaaaagggcccagctaattccctccagcccttttataagccactaatcccacttatgaggtcagagcccttatagcctaatcacctccaaaaggccccacctcataatattgttggattgaggattaactttcaacgtgaattttggggagaatacagtcaaaccatagcattcttcccctgacccctcaaaattcgtgtcctcatatacaaaattcatcccaaaatcgataacttattgcccaaattcttaacgtgttccagcattaactttaaagtctaagtctaaggtctcatttaaatatgatctatatcagatacagctgagactgaaggtacaagtcatcctaaggcacactcctccagctctgagcctatgaaatcaaacaagcgatgtgcttccaaaatacgatagtggtgcaggcataggatatacattcccattctgcaagggagaaatgggcaagaagaaagggtcacaggccccatggaattccaaaacccagcaaggcaaactgttaaatcttgaggcttgagaatggtcttgagtccatgttcatccttccgtacacactggggcaagggttggacatccaagggtcccacccgccctacccccatggctttgctgggcacagcccatgctgtagctctcacaagttggagtccagtgcctgtggctctcctaggctggcattgcacgctggtggctctaccagtttgggatctcagaggcaaccctgaccccacagctctgctgatcattgtcctagtagggaccgtctgcacctatctcacctttgtggcagttttctgtctgggctctgggctctccaagacatcttttgaaatctacgtggagacagccatgcctccacagctcatacactctatatacatgcagagttggcacttcaagaatgtcatcaaggcttattacttgtacctttcagaagggtggcccaggccacatctgagtccacttgagccccagctggggcagctaaaaagcactgtgttagaatgcggggagcaaagatctgaggaggccctaggcagtgaaacctgaggtgccatgggtgccctgggcccctcccttgaaacctttctgacttgaaggccctggtactctgggatcatgatgggagcggcagcctcaaagattgaaatgcctttggagtcattcttctattgtctggataaatagcatctggcttccttatagccacactaatctcatatcaaaagttacatttgcttagccacgcccttggtattctcttctgaacatgccctttgaatctttacaacctggcgaggctgaaaattttccagatctttaagttctgcttccctttttattgtaaattccatctttaattcatttctcttctcttgcattttatgataagcagtcaagaaaagccacatagtaccttgaacaatttgcttagatatttcttcaccaaatatcctagtatatcactcttaaattccaccctccacagagcactagaatgcggacacaatacagccaagttatttgccactttataacaaagatagcctttcctccagtttccagaacattttcatctgagacctcatcaaaatgacctttatcatccatatttctaacaacatttttattacaatcttttacgtaatctccaagaagactgaggctctgtctgtaactcttcatatgagcctttacgttttacagtccatttatggcaatctaggctttctctagcctactttgccaaactctttccgcctctacccattacccagttccaaagctgctcccacattttcaggtattcgctacagcagcaccccactactcattaccaatttctgttttagttcattccaggttgctataacaaaaaccttaagctggttactttataaacaatagaaatatatttctcatggttcttaagactgagaagtccaagatcaaatcaccagtaggttcagtatctggtcactgcttccaaggcaaaattaatccttattttattatcagcattccagtgaatagaaaaatcataggccaaatactaacaaattcaaggatgttttatcattagaaaatatgctaatataaatcacctcatcaacaaattttaaaaatgattatttcaatagctgcagaatatgttttgataaaattaaacgtgtttgtcattcaaaaaaaaaaaacctcttagctaactagtaatagaagggaatttacctaaattgacaaaaaaaaaatcaccaaaaacttgttatttagtggtgaaaagtcgtaggcattcaattgaaagagaagatcaagacaacctgtactttcaatcactgttgttgaagagaaatatctgtaaggacaaatcaaacctccttatggatatttctcttcaacatctaaacagtgattgaaaagggaaaaattaacttttagtttcagatgatataattgtatctaataaaaacacttaagtaagtctgcatatcaacaattagaataaagagaaatttctattaagttctgaaagacttttgtgaaaaaaattataaagctaaatttaaagatcctaaagaagaccaaaataaatgtatgctattccacattgatgtattggaagattcagtatacaataccttgaaaataaaatattcattcagaaatatccatgatacccaaatttatccttcaatacgatgtacgtctaatcaaaatctcaactggctttttatgaaacctaagatcctaaagtttatacgcaaagcaaacacaaatttccatgagtgattaaggaatgtccgtagattatgaacaaggttgatgagtatcatgtcaatattgttcatagggctatagaaattaagacattgagatattgacccagggacagacatagagaataataaatgaagcctataaacagacccacatagactccctcttgagtgacatgtgacaaaagatgtatggtggctcactggggaaagaaggtactcaatagatgggcctaagacaattgactacttatatgtaaaaacagtgaatttgtacctcccccttaagctttataagaacaactttgaattagtttacagcaaaagtgagaaacaaaacattacttaggaaaacatacaagacactatctgtatgaccacaggatggggaagcagttcttaaaacaatatataaagactagccataaagaaaaaaaaatcaatacggcaaacaacattaaactttagaacttccatatgatgatatacaacttaaaaacaagccatagcctaggggaattttcagtgcatacaaatgacagaagatggtaggcaaaatatattttcaaagtcctaccaatccatttgaaaaggacaaggcaaaaactgtacaaatgaaacaagaagctcaacggccaataagtgtaagaacgtaacacaagttccctaataatcatggaaagtcagttaaaaccaggaagcatcatttcataccagattagcaataatgaaaaaatctgacaataccagctgttatcaaatgctggcaaggggacctttagaggtgtaaattggtacaatcacttgggaaggcattttggccactcttgcaatgtctaaaatgtacattccctgcagtgcagtagacaaggttgcagaagggacatgtagtataccgccagtttatataaagtacgtaaaccaaaaaatcagatctatattgtatggatacatcacagtagtaaaatagcacagaaatgataaaaaataaattcagtaatatgtcaagggagggaaaagggggattgtgcaaagatcatcaaaggccaccaactttatctttgattctgttttccactaaaatgaaaaaaaaatacgcagcaaataatgaaagatgttaagatcagacagatatgctttggtggttcattagattattatccttttctgtatgctcagaagatttcataattcaatagagagggttcataggaagtaagaaagtgcagacaggaggtggaaactcattagagcagttttgtcctgaagagaaacaaagaaactggtagcagctggacctgtgcacagagggttatattccacagtgggtcattggaagcatgtttatatgttggttgagataactccatggatagtaagaaagtgtctacataatagagaaataagagaactccaggaactaagactttggaaagataagagttcataggtgttcgtttggagacagtagagccccccttgaatggtcattggagtaggaaccagggagaccaggtagaggcagaaatggaatcttcagtggtgcaaattgttccagggcagcatgttttagtaatgaagtatgaggctagatttgggtgggcagtagggaaaagacatgaacgttagaaaagattagagaaactataaaatcaacatcttggaaatcaggcaaacaaacttactgggagtgtgtactggaatctccatgctgtgttggacgaccagtcaaggctcatggtcatcaccctaaagtgaaccccatcagcatgtttgtgagattttctctaggaacattcagtagctcaggcacaggtgtggataacatggatgattgattccaaccaggaggtggtttccccagacaaacaggagagaggaacagaaaagtcgaggatgtctgtagggaggtgactttaaggatggtcacacaacgtaagctaacaaggaggacacagggacaaaaaggatcatggtttcaacagattggaggactagatgaggtccagaatctgaaagtttacttgtggtccaagatgtgttcgtgataataggggctgcagtggaattactgttgttcaacgagaggacgatcaccagcatcttagaggggtgatcagtatagatgtttaagtcagcagaaagaaacttcagtgaacgaagcaatgtgacacaggatgttcaacagacaatagccacaagcaaaatcattttatagatgttgaaaatgtggttcagagaatgaacctctacaaagcaaatcccaaactaataaccgaaggaacccgtgagtatttgaccccaaactccattctctttccagtaccaaactgcttatacaagtttcaacacagtaaactttaacaattatacaatggaattttatcttaatctccaataactcccctcaaaggagctggggatgacccttaaccagtatgactaatcagaaatatctggggaatattttcaacatacacaagccaaggctgatgctatacgtagtgaatcagagtctcccaggggtggggtccaggcctgtgatttcaaaaacattccccaggtgcatctgacgcacagcctgttcaagaaccagtggacttcagattattttcagtaccaaaactcacctgtttttaaagcacagatcattccaatagtcctgagaaagaactggaccaagagaacagactttagggcccagttgtatttacctggccatctctaatgtctggaattattgttttgtgtgccctatatagaaactcattccatcttggactgtattgagaagcatgtttttctattcagtatcttatgtaatcacaaaagagtcttagtgtttgcttactgtgctcaaagattcacttgtatcaatttattgataaaatacccacttttatcaatttgtttttataaagtgttttgcttgtcagtaatgtcgtctgcaaaattctcattgccagatgtattactttagggactacgtaaattatggggggtttctcgctctgtcactcacacaccttttctcttctgctaggatcagctttcacagctgtgtgcatgggggaagggccctctctgggatatgaactgaggaaggacgccccattgacctttgtttcctctctcctaccccaacctcccagctcaatcagcacagacatgattatgtaatcatgccaatataagagccacaattatgtttacttcacccttcccctacctctaggagataatatcatttcaactcacccagggaaatatatcagaattttggccaactgcagaaatagcctatataaatacactgctcccagaaaattctgccacaccttccagcctccaccaagtcaaacactgggtgagctggactgccttctatttcatcccctggattcttgtggggtggggtgtgtggacataatgtcagattcatccctatgtggtgacagtatcaatgaagttataaatatctaaggcttgtggcattccctagcgaagtgtctcacaatatacctttcatatatcaataactaacaggttttgagtatttcctgcttgccaggctctggtctaagaggtttaaaatgttaatgtatcgacctcttgaattaactgtctgtgctggggaatgttattacccccactttatggataagaacattgaggcacagagaggttgagtaaattcccccacgatgaaacagctaggaggcataattgggagacagacagtggcatagctggcttcggagactggctcttccccaacacctccatggtgcaccagggccagggttgacaaactttctccataaagggccagagagcaaatatgttaggctttgtgagccatacagtctctgttgcagctctagacaatatgtaaatgaattgtgttccaataacaatttatttacaaaaacagaccagatttggcctccaggtcatagtttgctgatccctgctctagcccagtggttctcaaatttgagcatgctttaaaatcatcagaaggactttctaaaatcagattggtgcccaacaacatcctgagtttctgattcggtgggctttggatggggcccacactttgcatctttagccgttcccaagtgatgctaatgctgtggatctaggaactactctttgagaaccactgcctaaaggaacattaacaaacacagcttgcaggttatcttctgaaagcaaatcaacgttaatgtaaaatcttaccattcctctaagtcatgatgacttagagactcctttgtctcgcagtctctggacaaagaccattttttatcttcttggtattcacagtgtctgagatggtggcttctgtgtcctaggtactcaaaaatggttgctcgtggaatgaaactcaaatgaatgactgtaatgctatgttaggtcgttcccattaattttaaaatgtgatgaaaatactcaggattggagtaaattgctctacctcagagaatgacattacctaatataggcaatttgtttgtatggtatagtaagtcatttttcccagttcacgcatttaaagagaatatacaccttaagatagccctgagtttttcccaagtcacattaaatgtagcctgccccaagttatgatcctacataagaagcagctcttgtttgtcaagatactgttccttagagatgaggtaaaaaagaagtcgtaggttatgggattttacagaaggcattaccagtcccggcaaaaccagttcttaaaaaaagattaggatcaggctgactggacacacctagatataacttgagcagaggatacctgccaggactgatttcccccttgggtaaacagccagatgcaaggcaatgcacaggccatttaaaatctcagtgctgtgactgaaccagagcctcgtggttcactttatttagaaaaacaggtgggaaattaaaaatcctccaaactattttgaattggaaaaagaaaacctcatttggtttcaaagcatgttttttttttttattttttatttttcctaactctgagaaaacgtgaacactgcagcgagtaaaaagactgctcactgccttccatatacacaaatcagggctttcctgcatccaaatgttactttgaactgacaaaacactcttggcactttaattttatttcataacgaaaaggcaaacttaacttctaagcatttttattccaagtttaatggcttacattcccggggtcagcaagcagatggagttggagacgagaatgtataattgcagattatgaaacagcaaaattaatgttactttgttaatgtcaagataggatttgagagctagaagggattttcaagatcattgatcctaaacctcatcatacagatgaagacactgaggctgaagtgattatgtgtcctgcccagctttgcaaagccagttggggacggagctgcatctgctgcctggtctcctggcaattaggccagtcctcccactgcagtatgccactatcctcatcagttccttacaagaaagaggctcgtatttatccttcactgctttacctttcagtgtagaagtgtgtgtgtgtgtgtgtgtgtgtgtgtgtgtgtaataaaggggagaagaagaagaagaaggagaaggagaaggagaaggagaaggagaaggagaaggagaaggaggagaagaaggagaaagaagagcgaagagccagaactgttggcttgcaaccatctgcaaatttcctagggatgtggctccttctgtctgtggctctgccattctcagtgggctgcccacatcgtcatggtccatgattaaccatcatcttgaaaattccagccaggagggaggagagaaaggagaagtggagtgcatacttttccccatacaaatgtgccctggatggcacacatgcacttccttggccagaacttacttgcattgacagacctagattgtgggtcaccatgcacccagctaaatatagtatatagtattatatccaatagaagaaacaatggtcactgagggctacctagaggtttcttagttgactccctggccatccaatatctgtgcttacctttcatctcacataaagaacacacgtattccccacctaagggaggcaatctctgtatatatcttattgctactgctttcaccttcaagttcatgatctgtacctgacacacactgttattcactgcatccaggcttcctcctctcagttgaacaactgtaaactaaaagacaagttttctgtccacccattggatccaatatagaatggtagagtaggaaaagaaacttcagtggcagacaaatggcagtggtggatccctgctaatgaaggcatgcttcccaagagttccagctgtaagagtgaagtcactccatctggtatcccctgggaaactctctggaaggagatcactaggagtgtgtggaagggtgtattagtccattttcacactgctataaagatactacctgagattgggtaatttataaacaaaagaggtttaattgactcacagttcctcatggctggggaggcctcaggaaacttacaatcatggtggaaggcaaaggcaaagcaaagcagcacgtcttacatgacagcaggagaaagagcgcttgcaggggaaactgccagacacttatcaaacaaccagatctcatgaggactccctcactatcatgagaacagcatggaggaaactgcccccatgagccaacacgtcccaccacgtccctccctcaacccatggggattacaattctagatgcgatttgaatggggacacagatccaagccatatcagagtgcattgctctggttcagctggggcacacagcctttgccactcacccccagcagggtggcctgactcacgcccagcagggtggtctgagtcaccaatcaagcttgtctggtggcttctttggcaacacaatttcctcaaaaacttagcaggcaactgtcatttaaacctgaagatttcgcttctttatttcctggcctctgggtactgccaaaagtcctctcgagttaatggtgtctcccttgggagtttcagtaacatagtctttgcgggaagtaaatccccttattctggtctctcattttttggcagaaaattccgtatgtgagaagacttagcaaaataggatcacacagttctatctcctccccttgcagtctatttggagccacctcttctcaccgtttcagttttggataaggtttggctttatcaaacttgcaaagtcccaagataactcatattcacttcaagttgactatgtgagccatgaggatgttcctgtcatgagaggatctaacttagcggagctctggttctctttcatttttgcttgatgtccagccgcctctagcataaattggcctctctcatgaggacttcgctgaaagtgtcaagtgtcaacaacaaaacatcaacattctgaattttctgatcatttcccctaatgttggtcatgccctgtgttcttcatcccaagatgctgcagatgacaatgtcattagatgctttgtccctgcataacaagggtcaccagctttctacccaccaaaatctgcatttttgctgtccactgtccagatgctttctctaagacaatgacatcagtgtggccagctggattctaacaaatgccacgcacaacattctcttccaaataccaaattctgccatatacattcagctgtgtatgagaatgatccaaatttgcagtgacctaaacacaaaatgagtttattgctttctcccataaacatctaatgtggtaactgtgctctacaaggtcatggggtgctcaggttccttctccttgtcattttaccacgccttggtgattttctggtttctatggcccaatatttctcagcaccatatctgcttttcagccaataggaggggagtgagatggttggtattatcatcttgcctattaagtaaggcacaatttggagatttcacgcatcacttcattcaatcccattattcggaatttaatctcaggaataaacttacttttttaggatgtcagagtccccagacaagggtttttattgctaaagaagtagaggaagtttatattgcagaacatgaacagtctctgctgcattatgtacatctttttaatgttcagcataaatatctagaacacaacctataattagtttaaagatgtaattcagcatggatatgctgtttacctctaaatctccttatctagaatattagtgaacctaccaaccaggaattcttgggaaatttcttatccaaacctttaaggttatctgatcttttgctgtcatttcattttcctctaactcttccaaaatgggcatccacacagaattctgtcagaccagcatttgatatccaaaatgatattaattaggtgaataagtctttatgtaactgttcaaactccacattttggatgtatctggtttaactcactattttaacttgcccattaagcttctattttcaatgaacataatttttattactagaatttacataatcttttggcaaaatgttgaacttattttctgttttctgttgtgtcattagtatctcaagcatgctaattttttagtcgttatcctattattctcatatctgaatctactgtgttttctgctaattttcgcacatcgtagcctgttctttttatgatttttaaaagtagattgtgagtttgtttgctctgtggggctttatgaaaatcctgagtgtcctggattaaaagtttccctttcctagaaggttctggacatttaggagtggtaccacgcggggataaatttttgttgttgttactttcctcctttgggggctcccaagtatagtcacatcaaactaaaaccttatgagagaaacacttattatcttaagggaagagttttttccaccaagatcccagaagacaatctctttgttatctatttgctggtgagtggatgttttacatgcctgttcaatagggctgactgtactgggatgggatgggatttcaccacatcatcatgcatgccccaaggacttatttcctctgacccctaaaatccatgcctatggtcgttggttaccaagaaaggcacaccctgtttccccctgctccccacctccaactcacccaacacaactgaatgaacatctattctttattttgtggccttgggaatttccttactttcttttgagcttagctatgtatttcaaagaagctgagtttatttttttctagcctttctaggtgttctgtagtagtatagtttcatattacttaactgtttccataaagaaaagtcagctccctaatttcatccatgaagttgcaaactgttacctacttcaacctaataaatcgcaatggaagcaacaggaaaacaatatttacaacatttgtgagggacaagtggtcagcatacttgtataacgtggcatatctggctatttaagctggattccagaggctcttcagtacaaacagtgactctacctctccttccccagcaactcactgtgttgcgcaaatctcagtaagagtttacactctctgctagccccagtaatagggaaggcaacgtggatgggaggcatgaaaaaggcaaagttcaaagaaggaggtctacatttgtgctcctgtattttaggcaagaccagaagatatggggggactcatgactttgaaagttcatgagaaactttatgagactcacaagccctaggagaaatgcttctaggcctaggaaatcagatatagtgtaaaattataaaaaagagcatattccctatttctggaagcctggaaaattcttttttttaagacagggtctcactggctcatccagactgaagtgcagtggtatttcacgactcaccatagcctcagctgcctgggctcaagcgattctcccacctcagcctttcaagtatctgggacacaggcatgccccaccacacccagccaatttttaaaattatttgtagagatgaggctggtctcaaattcccgggctcaagcgatcctcccgcctcagcctcccaaagtgcggggattacagatgtgagtcactgcatgcagtgtggaaaattcttgcaacattagaacaggcatggcagagtttatgggattggcaccactctttttccacccaagagacgatagtttttctgttgacttcctcagggtattcttgactgttggtggcagcagtgtggcttcccaatactgtgtcttgacagtagacaggggcaagtgggagccagcgctagacgcgcagaggaaggcagacagcaggtgggatgggagctcaccaactgggctcgttggctcgtgtgaagcactcctttggggactcccagaagtaactcagagaaaatgctttgtagggagctaatttttagcaatcaggctaggggtcactgagctcccataattgattgagtctctaaagttaaggggactttatactggcaagatatgggtagaccatgtgagtgctgctaaacatataaagagagttcaagtgatgggcatttagggtgattccataaagaaaatgtggcatatatacaccatggaatactatacagccacaaaaaaatgagaccatgtcctttgcaggaacatggatggagctggaggccattatccttagcaaactaacttaggaacagaaaaccaaataccacatattctcatttataagtgggagctaaatgatgagaacacatggacacatagaggggagcaacacacacttgggcctatcagagggtggggaatgggaggagggagaggatcaggaagaataactaatggatactaggcttaatacctgtgtgacaaaataatctgtacaacaaacccccatgacacaagtttgcctatgtaacagacctgcacatgtacccctgaacttggaagtaaaaagaaaaaagaatgcttaagaaaaagacagtctcaaacaaaagatgaatgaaagacaactcataaaaagagaaatgaaatagatttcacatataaaaagaaattttactaaaaaatttaaaaataaattaacgatattatttccatttaccaaactgacagagattattatgtgtttgccctcttatttctctgactgatgggcatgtaaacttgtataaatgtgacaaagaaaaatacttcacaagagcttttaaaacatgcagaccaggccggacatgacggctcacgcctgtaatcccagcactttgggaggccaaggcgggtggatcacgaggtcaggagatcgagaccatcctggctaacacagtgaaaccccctctctactaaaaatacaaaaaattagccgggcatggtagcgggcacctgtaatcccagctactcaggaggctgaggcaggagaatggcgtgaaccagggaggcggagcttgcagtgagccgagatcgcgccactgcactccagcctgggcgacagagaaagactccgtctcaaaaaaacaaacaaacaaacaaacaaacaaaacaaacaaacaaacaaaaccgtgcagaccatttcactccaaattaatttaaagaaataataaaagaggtttgcaaaagttggggacagagattgccagtatgaggctctcatattggtaaaaagatggaagcaacataaatacctcacaataaaagaataatcaaatgaattttctatagctataatgaagcctgttgaatcttatggccttttcaatgcctatttcaacacatggaaacttgtttatgagatactcataaaaatttttataatgtaattacattatgacataggtgagtagcacaggttgtaaaacagtatgtatgggatataatcctaattttgtatatttatacaagtatgcactgaaaaactggaagtttgtacagtcatccctcattatccatggaggattggttctgggactccctatggatatcaaaatccatggaggctcaagtctcttattaaaatgtagcacttgaatataatctacacatatcctactatgtactttaaatcatctgtagattaaatcatctgtaatacaatgccaatgctacataaacggttgttatactatgttgttaagggaataatgacaagaaaaagtctgtgaatgttcagtacagatgcaactctccattttttaacaacatttaaaaacccacaggtatggaggactgacagcacacagataagtggttatcacgttcttcattctgaatttctccactacatttttttttcacaataagcatgagctgtctctatattcaacaaaaaaaagaataaatgctattgttatggtcatattgtcttcatcaattggcttttcgtgcccctagagttttactcccattgtttctgatgcacagatctggagagaagctcaagagaaggaaggctccctcttcccactctgagctcctacaaccagggctggcccctcacagctgctgccaaagaggatctccagagacccagttggcttttgcttggaggcccccatttatggttgggacgttcccttagttaactgttcccctacattgaggactcacgtttctcattttttttgtttttctctttgctttgttttgaatgatccctttctggattattctgctggttagcaatttcatcactcactccccataccgagttgcctacgcatattgggttaaaccagagaaaagtgttttctatggaagttaaaaaaaaaacgtaaataatagcactttgatctcatttaacctatttctatgatacctaagttatcccatcaaagtggaaaacatttcatttttctgattagaaattctggttaactggttgccccacatgggtagtggtgccaggcagagctacaaggaccctgagcaatactttcacatgagcaggaattggttgatttttacttcagtatttttcgaatattgctttctcactaatctaagctatcaacttggaggatcaggttagagtattgacattgaaataagcttcatatatataaaaaagaacagtttcctcctggattcaatttaaaggaataagcaagaaaagaaaaaaatagataactctcacaaaatttaataaattgattggatttgtgagatatttttaaataaaatttaattcaaaatgttgaaactacagatgactggaaataatgtaaaaatagaaatccaattttaaaatacatatttcatgttggagtagaagaaacgtgcatctcaacttattcctaaagttctcaaagtagaagaataaaataaaatgtaatctagaaataaaagtagaaacctttcagcagctcttgggcaatgattagtaaatgggtcaagtaattactatttaatgtaattgtcattttctttgtaatagtttattgcctttaaccttggtttaagaaatgagattctgttggtatgaaagtaatgatatgagtattcctcaggcaggtagttggatgcacatatctgaaattcaagagagtggatatgggagtcctccattcacagatgatgagtctggatgagaacttagagtgagaagaaccaagtgcaagaattgagttcctgagctcagaattcagggaaaaaagagaaaccagtaatgaattcatgagtgcccaatgagacaagaggaaaactaggagagctcagtgtagggaagccaggagcaggaatatgtctaggaagaggcagaaatcaaccccattaatgctgccaaaaaaggcagctacatagagaattgcccattggatctaactatgccaaggtcactggggaccttaacaagggcagcttttgtggagtcatgaggctgagacaaggtgagacagtagtgagtctgagagaagtggagaatggagaataagcttttttattttttttatttttttaagttttgctgcaaagaataatggtggtggcttgaatcctaacatttcaactcaaaccaagagcaaaatgaggaccacttatctaaatatttaaaatgtaagtgaaactaacaaattgtttcagaaaagatgctctatcttcataccttgggaaaacatacttttgatgtaagatgtttccacaggaagaaagtggcagaaaagtatctgggatctctctgaagattttcttacaactgcgtgtaaatctacaattgtctcaaaatgtacctcaaaaattatcattacaattatctcaaaagttaaaaactgttacctttgttaataacctggaagtacaggcttgagtttagacattagaattcctcagagttctgcttcagaacccggagaaaggactatctgtagaattttcagggcccagtgaaatgaaaatatggggcccctggttcaaaaatgatgaagaatttcaagatgttaacagccagacattaaaccaaatgtggagaccatgtgaacccaagaccccgtctgactgcacaggatgcatggtctccttctagcaggtgtttgcacttgtgtggtttgaacttctccctggcaccatcatcttgcccgcctgtgaggcagaaagagagggaaggtgtaagttgaaagctgtcagaggtcaaacatcaaaaatagagacagattcttgatgacacacttgcatccttcaagtctttgttcataaaccgctgtctcaatgacacctacttgattatctgatttaagatgtcgccccctctcctcacatgcccattactgatctatattttttttccagagcatgtatcaccttctaacaaaatgcatactttattttattgtgattattgttgatctcctctcactactaagttaacaccataaggacagggatttttgtcttttttgtactgaaaaccatgacaagcccatatttagtgcccaataatatagcaaataaatgtatggttggggaaacttagggtccaataaatcagccttaatgtgagggttccctggaaaaaattccccaactacagaatatctgtctcctcttgaatgtgactcccaaatgacacagtggcacactcttgtttcctctttaagatgcaaacattacaaaggcttcacatcattcaactctagggttgagtttgccttttattgcttttggacataagaccacagaccaaagcaagaatagtggagatgtcgcctttaaaatataaaactgaaaacagcaaaagttagagagtgactgagtaggagaataggcaacattttaaagttgattttacaaaggcagtcatcagacagcactgtgtcattttaactcaagattctcaagtggctctcatgctgattgttaaagcaggagaatgattggccctaagatgatgtactcctcccaggaatctgaaattcatagatcatctggaaggaccagagtgcttgtggagtgatgggggatggggtagattattatgagaaagaagagggctcctcaaaggaaaaatgcaaaaaggagactgtaagacagaggcatcaaaagcagatttcatcacttccccagggctcctgagcgcgagagggaattgtctgagtctaattaagaagcatggactttggatcttattgcaggttatggataaaatcagtctcatatcaagtcgtcttgcttctggtgcctgtgtttattaagcttcaggaatagaggaaaagccgaaaggctccttccaggagccctgccttttgtgttatctctgctctttatgatcaacgtgaggaagctctacctacacctccacagcacttaaccgtgtctctttgattagttgggttccaaaccaagattgtgtctcacttttgggccttctcatggctgcctgctggagtaagataatgaagtaaaaagaagttggacaaaagaaaagaaaaaaaataaaaagtttacctgttttagtcctacactttccagtactccatggaaaattccatctcttcatttgatggtctcgattctagaattcaaatgttgccccatcacttttccccagcttgccccccactctggatgtgggatgtggctgaatctcaattattacacaaaatggaaatggaggcacatcagagatttattgtttcaaccttggagactgaaatatattaaaataaatggcaaaaatcatgaatctttgcttgaaaatgcttgtgagttttcaccttgggaattcaaggttacataactagataattacgctttgcataatatgtcaatctttgggcttccgtatcagtcacaacattagcaaaagaagaaaatcttcagcagtctatacccagctgctaccgtggaaacatcccaaagtctaattaagagtttgaaaaaatagttgtaacactccccgaagaactcatctgcattccaacagtattgagaagagtgataatagaattccaccatgtagttaatattagtaagtccaggaaaggattaaagaacaaacattttgaccagagcatagggagatttgacaatttttgcccagaaggactgatgtgacagccgtgtgtggctcctcccattcttcatctgtacaaatggaagagtttattgtgtcactgttcttcaaagataactttcattattgttgtttgcttttgttgttgctgttcataagtcttcagatcaagaagtgtcagatggagagactacagaaaacactgacctttgattgacagtgattaggcggtgttttcttccactagagcatgagatacgtcacacagagggagagaaatgaagatgtatggccaagagggtgcactgggataacttgttttgtcaactcttggctctctcttcctggaagaagattctccctccccttcttcacatggtcagactggacaaggagacttgctttggctagcagtgtgagctgacaaggtatgtacactgcatctgagcagatgctttaagaacgttggtgtgggccgggcgcggtggcttatgcctgtaattccgacatttagggaggctgaggcgggcggatcacgaggtcaggagataaagaccatcctggccaatatggtgaaaacctgtctctactaaatgtacaaaaattagctgggtgtggctgcatgcctgtagttccagctactccagaggctgaggctccagtgagcccagatcatgccactgccctccagcctgggctacagagtgagactccatctaaaaaaaaaaaaactttggtatgtttgtctcacctctgaggctccttgcctttggccatgatcaggacatgtctcaagtaggggctgctccttcagcttttatcctgaataaagtttcatgaagccaacccacagggaatgtaaaatgtgaatgagaaataaaccagagatttgagggttgagggttgtttggaactgtagcaaaataaatatagtgaaaactgacagattctggaattacctatatagttgagtacctgcacaacaagagtaaagcaatgttgtgcctagaaagcatcaggtcaatatggccaaaggtttctttgtcaaagtttaaaagatctgagaaggccaggtgatgtggctcatgcctgtcatcccagcactttgagagaccaaagtgggaggatcacttgaggccaagagtttgagactagcttgggtaacataatgagaccccatctctacaaaaattaaaaatcagctggtcatggttgtgcacaactgtagtcctagctactggagaggctgaggctggaggatcacatgaggccaggagtttgaggttacagtgagctatgattgcacaccacaccccagccacagcaacctagtgagaccctgtctcaaaaaaaaaaagaaaaagaagtttgaaaaacaaagggttggcagcatataaacaaaacatctagactctcttgggtagtctagactgaaacgtagactgaaatgatgatgtggcctgccctactgtttggctgtaatcaccgtgccaaaagaatttgtagtgcttttgaatttaggaaaattctggcaagtaggacttacttgcattctatgtaactatactgtgtgctgaatatgattttctcagggagtaatcaaaacagatttctttgaagatgaagcaaagttcagaggttttgttacctgaatatctgtacatttagaatgggatgtctagccgtaactgattcgaaggttatttgatttctctcctgctttatgtaagttagttttagaggggggtagacagattgctattctctgttccattcctcttgttatccccaaacaaaaatattaaggcctcaacattcctttttaaaaaatcaacattaaagctcacacattcaaagtcatttgtataaattacatggaaagctgttgccctcccacaatcggtgggctctaaacagaagtctgacacagcttgtcagtgttcttgttggggcatcaataaccttggcctttgggaaggagagatggatgaagacggatgggtggtggactccgccagtcaggtctctccactgccaatcatggacaccagcacattcactagaggcagagctactcaaatgcaattaccagatgccgccgccagaacaactgttcctcatctcactcagagccattgctctggcttttctgctacctcttaatcattttaataatgtgacgtgctgctttttctttgtttggtgtatgctgcagtgacaatattttccaaagaatgattcataatgtgttagaattcatagtttacatgtgcctgtcaaccatttgtaatgcaggtgtttagaaagttagcatatttgagtagagccctgatagtgaaagaggcatgtttgaatgtacgtaaagtcaataggaaaaatttaggcacacatatgccttagctttctttaaatataaatactttatatttccttaaataaaatataaacctaccatacattaatttatttgagtggtttctgctctctgtatattttcaacttatacttctgctttattaggacaatgctagctgctgtaacaaataagtccaacactttggttgtttaatataatgcagtttttgttgttgttgttcatggatcatgtaagagtccagtgagaaattcctggaaagtagtcagttttcctttaactcgtgactcagagatcctaaagccttccatcttgtggctccactatgccctgggtgctatagtagaccctcaaagtcttcttcctctaaccagcagaaggacaaaaagacagcaaaaaaaaaaaaaaaaaaaaaaaaaaaaaaaaaaaaagcatatctgcttcttaaataccccagctcagaagtgacacacatatcactcccactcatatcacattgaagataattggatatggccagacttaaatgtaaagttgaggtggaaaatgttgtcctaagttgggaaaccacctaccaaaaccatctctatattatggaagaaagagtaccattttttgttggatagttctctgtctgtgccacaaacaccttgtgcgataataagtttttgctcgtatattttaaaacacaggacttctttttatgtcaatgttatgtcaattctatttcaaaattcaaggggtaacttttacatacatcactggatgactaacattctgcttccatctttctgtacaaacaatttgtattctagttctcaaagcattgttatgtaatgcttgctgattcatattcacttaaacagggttcatatggagagtttcacacccatgatttggggttgaggacaaacataacaacatgtacctcacacactcttcgcttacataccataaaaccattaatactatgaccccagagacttactccccagaaagaatccaagtaatttctaattctcccccattattcatttactcattcagaaatactcattaatttcctgctagatgccaggcatgaagtctcattttacattcttcagccagtgtaaaatattccatgtaactacctataatttttaatgtcaattcattaagaactttccaaagggaaatgcatcatattacctgattctgcacctcttccctgtaacatgtccacctgcttattctttttctcaaaatgctctggcttcttactgctcagccgggaagccattctcccacagtgcttatgtactaaagtgtaaacgctgagctgcttttactggcgtggagcagtggctcacagtttcggagaccatactcttcacctcccttccccaactccttcttgtgccttccactcacctggggaatccatcagccctttagctctttagcggaaaaagccactttgctgaacaaaagtctgtctctcaccactccttgatcatcccatgaggtcccatcccagaaagtctcactttgaggaacaaggaaagaagtccatactaaggacttggtaataaagttagattggttttcaactttgttttgttctattttattttcaaccaaaatgaaggagaactcaattgaattgtcagctgatagatcgttaaaagcaatttttgatgataaaatgtagtatgatttctggagtatagtttggaaagtattcaaagaattgagtggcattgttataacaatctgactctatttccatctatttatgtggatgaattttctaagtagttgaacttataaaactgagaaataggaatagaattgatgttaaatcttttttcactttagcaataagtaatatttatatggggacatatgaactaaaagaaaaaagaataaaaaggaaaaggaagaaaatagaagaaaaaatccctcttgctaaggatgcatttttcaataaaatgttatgttctttcatataattataaaaatttgtgagacatttttatttttgttttattgtaccatggtaattattgcaatgataactaaatccacaattattcaaaatatagaccagagtatttaaaatatcacatattttagaaaattaaatatgaatacatactcatatttatattgtagagaagtataatggaaatgcagatttaatgactgaaacaaattttgtgaaacttctcctatgaaagaagagtttgttcaggtagtttaaaaatagtgaatagtagatatcaaattactttggaatttagattttattggatatatttacagaagaaaatataaaggttttacttaaaatttccagtgtttgtaagacattaaaacttaaagacttacatgttagaactaaaaccataaaaaccctagaagaaaacctaggcaataccattcaggacataggcatgggcaagagcttcatgtctaaaacaccaaaagcaatggcaacaaaagctaaaattgacaaatggaatctaattaaactcaagagcttctgcacagcaaaagaaactaccatcagagtgaacaggcaacctacagaatgggagaaaatttttgcaacctactcatctgacaaagggctaatatccagaatctacaatgaacttaaacaaatttacaagaaaaaaacaaccccatcaaaaagtgcgcgaagtatatgaacagacacttctcaaaagaagacatttatgcagccaaaaaacacatgaaaaaatgctcatcatcactggctatcagagaaatgcaaatcaaaaccacaatgagataccatctcacaccagttagaatggcaatcattaaaaagtcaggaaacaacagatgctggaaaggatgtggagaaataggaacacttttacactgttggtgggagtgtaaactagttcaaccattgtggaagtcggtgtggtgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaacgatgagttcatgtcctttgtagggacgtggatgaagctggaaaccatcattctcagcaaactatcgcaaggacaaaaaaccaaacactgcatgttctcactcataggtgggaactgaacaatgagaacacatggacacaggaaggggaacatcacacaccggggactgttgtggggtggggggaagggggagggatagcattaggagatatacctaatgctaaatgacgagttaatgggtgcagcacaccaacatggcacgtgtatacatatataacaaacctgcatgttgtgcatatttaccctaagacttaaagtataataataataaaattttttaaaaaagttaatctggcacagattgtctgaaccacaaaaaaaaatttatatccttgtaattatttaaatttatgataaaacattttggatattaacctaaaatgtgagaagggatatatagtttttcaacatccttttgggaaaagtatttgaatatttctatcatggtgttagtgtacatccacatttgcatgcaccagattgaactagaagcagacagtatgctcacatccaggtcttctccctcttacctgaacaccttggggttggagacatatctaacttcacaaaggtaatatgatgcctataccatacagtacgtaaagacctgtggtgggttaaaatgatcacaaatcctttgctacttctctttttgagagatggggtctattctccttgtcctgaagtctgggctggactgtgacttggccactaaaaggcagtgtaagtgacatggtaacctttgagtctgggccttaggaaagctgcagctttacttcaatcttcttggagttcaacctcttaaaatccaaaagccttgctgaagaagtccaaatgagttgcacggagaaggctcatggaaaataactgacatagccaaaggcccagctcagccctacctgacagccagcaccaactgccagccatgtgagtgagctgagccacctctggcatccccagctcaagggaacctccagctgactgcaacccccagctgatactaggaggaacagaagaaccacccagctaagcccatcaacccttagaatcatgagataataaatggctgctgttagtttaagctgtatgatttggtgtagctcattacatagcaatagataattggcattttccaccaatggagtctaggacagcattatgaatttgaatctgaaccttagagcccagatgaaatctgttctccagaatggagtcactaataacacccatcagaggttccctgtaaccttataaccatcactgcacactcagaggcacctttcattggctttttgtatcttttcttgttgccacattagctcataagctccctgaaggcagggaaatattcttcttctctatctgtctggaagtcccaacctttgggctttgcacccaaacacacccacaaggtgaaaacttgccatcctcaagtattcttctatctcatcttagtgtattatatatgtctacaattacccctcttttgtagatatggaaactgatgcccagagatgtcaagatgtttctcaaagtcacacagctaataaatggaaatgcttggatttgaacatgggtaggtgagctttggagcactacaaatgctgtctatattttgaataaccatcagctgagctgcctaattcagccagtaagcatttcttaggtgacaggaggttatatatgaactggtacctttcttcctacaaaatttgatacatttagcaaatgtttagagaccagcaaaatactgtattagttacccaaagtgatacaaagatgattgactattcatggaaatcactcagaagtcaaatatacaggtataaaaatgtatactgctcacacaatttgcatttgcaaaaatgtgaaaccagtccaaatgcccatcaatcaacaagtggttaaagaaactgtggtgtgtatataatacacacacacacacacacacacacacacacacacacacacacaatgggctacttctcagccataaaaaggaatgaattaatggcattcacagcaacctgaatgggattggagactattattctaagtgaagtaactcaggaatggaaaaccaaacatcgtgtgttctcactcataagtggaagctaagctgtgatgatgcaaaggcataagtaggatacaatggactttgcagactcaggggaaagggtgagaagtgggtgagacataaaagactacaaattgagttcagtgtatacagctcaggtgatgggtgcacccaaaatctcacaaatcaacgctaaggaacttattcatataaccaaataccacctgttccccaaaaacctatggaaataaaaatttttttaaaaaaacaattattgcaataaaacaagtcacatatacacacacatagtaagtatatatatatatatatatacactgtgtatatatatctacacacatatatatacagtatatatatatacactgtatatatatatctacacatatatatacagtgtatatatatacatataatagtgaattaataaactactagttcgatctccctggctcatttgtcaaggagcttacaatctctcttattaagaaaacacatattcattaaagcaggtgctcttataaaaagaggtacagccaaataagaccacaaggtaaaagaaatacaagctttaataacaatctaattatgcccaaatgatgcttaccagatacaagctttacttaaatctttttccccccttttcacttaaccgttgtggacaccttagaccttctcaacagtcccctttcttccagggccaagtccttcccaactccaagcccctcacaattctagggttcctccctgccccccttcattcttcctgctattcatgtgtttgcttcaccaaaagtcttcatcctgcactggtcattggccctgtgtcctcctcttctttgaaatgtactgattttaaaacttcccctcttggtgagaagttttctattttatagccctgccttttccagaaaccagatgccttttctcctgaatatttggaagtctgcaaaagcaaccaaattcatttaaagtgacacctgagaggatgaattcctgaaaggtgcatttaatcaaggttaaccagtttgccatggcctgaaattacgacatgtcatgttagaaagatgtacaatttggcaacattttcaaagtctgtaggttttgaacctacagtaaaccattgacctccctattttaggggcaaacacttttgaagagaatctgcattccacttgctaaaccatataaaacaaggtggaagagaaaaaagattcaattaaacatcacttggggatttcaaagaaaagatattaatctgtcttctcataaaactcttcacccacaattgtgatgaatttgaatgattagtaataatctctcagacttaaaaaaaacagacagctggatcattgaatttgaaaaataatcctttgctatttacatagaaatcgttagaggctgagtttttaggtttatagttttacagtaataaaattattttttttaaattagccaggtgtgatagttgtgcacatttagtcccagctactcaggagactgaggcaggaagattgcttgagcccaagagttcaaggttgcagtaagctatgattgtatcacccagcctggagaacagagtaagactctgtctctaaaagtaataaaataaggctgggtgtggtggctcacacctgtaatcccagcactttgggaggctgaggtgggtggatcatgaggtcaagagatcgagaccatcctggccaacatggtgaaaccccatctctactaaaaatacaaaaattagccaggtgcggtggtgggtgcctgtagtcccagctactcgggaggctgaggcaggagaatcgcttgaacctgggaggcggaggttgcagtgagccaagattgtaccactgcactccagcctggcgacagagtgagaatccgtctcaaataataataataataataaaataaaataaatataaatataaacaaggttaatatttgtatttataacatagaattatatataaatacccagtttgccatttaaatagttaacatctagggcattgtagaatatgcatatttaggttcatacagaggctatgtatttaggtagtattgttgacaaaatatcaacaatattgccctaaaagactgcttctgaaattagaaaagcttcacattttaaaagaaatgcaaatatttgtctatttgctgctcactttcgctgtatcacaaaacacctgaagggctacttgccttcggattttcttatcttaatggtaaacagtgttgacgatgaaaatcacacagcactttgctgcaaatctgagtttttatgtgtagtggataaatggcacatccgtgcccagtgctatgaattgctcctctgaaatcatgactcaaagagggcctggaaagatgaataactgtccactcctggacaatcatctccaccgctgctctgaggtcaggtaacagcagggggcttatgtcttctcacttgcttagggacatgaagtccatccctgcaacatagtctccctgacaaagcttcccaggaaattaaggtctctttgtaacttgttatctattagaggtaactgtctgcatttctgaaaactgatcagctcctaaaggcctaagagcgtagccacttgccctttgctcttggcccccactgacactattctgaggatataggctcaacttaagtggaccttgataaggcaagcatgaattgctgcaggcttgtgcacacaggatgtggcccactcacattaggtggcccattctgtggttgttctaaactcaaggtcagtaatgatcataaataaattgcaccaaagtgccggaggatgaaggacaagattgcttcacaggctggagattagagctattgtagcttgatgaagtagccagtggtccccacacttcctggacagctagcttattaggaataagtctttgtcatcaaattgcagagaagactgcaaactcctcttactggttttatgagtaactgtacccgagggaggcttgcatgactgtctggtaaactccaggctgggaaccatttgtgaatatggttgcagaggatttcagtgtgaataagaccaggtgcctgaaaagctagattttaatagaatgatacaatcaataatattaccatttaacatgttgtatcagttagaattgggcagttgcatggaagagaaggcccaaacagtgctttatccaaaatagaaatatatttgttgcacctgtaaaagcagagtcccaagaaaggcatcaagggagtgtgtggacctgctttcctaagtctgcaggacacaggatctgtccagctcataccgcttctgttcccagaatgtgtctcgtgacctcagtgtccaggcaggatgtcagagctccagccatcgcagccatggtccagggaggaagaaggtggccctcttccattcagagacactttctgggaattgcatgaagcacttgtacttacatttcatgggccgaaacacatggtcacatctgggttcaagagacatacgcaagcagtcatttggtttgatgccaaagagactagaaaaaaagaactggggtcttattactaagaaaaagtaggaaagtgtatattgggaggcgggggcaagtaggagcttctgctacatataattataacctcttaccgtgtaaatgactttccattaggggctactttttaaaaacaaaattttctcttttaaagctgtcatattatttaaacctagaaacaaaataaatgaacaatgcttgcctgctcatgatgatgatgtagagaattatattctggctagaaattatttgaaatccaataaactgtactaattatatattaactcatcaagttcctaaagaactttgatattgtaaagtaccacagaattaaaatataattctcactaagctagattgagatttttttattgaaatttactttgctaaaaataaaataacagcaaaaagtctataagagaagattgtactcatcagtccagaagttctaaaactaaaatccctaaagctttttaaagtattaggattctagtcatagaattaaaccatttattctcttgaaaaaagggttacaatgacctctccagtgtcctcccctcaagacacacacacacattaaaatttatattttgaattctaaatctggttgctacgacaactacaaaaacgacactcactttcattggggcatgctggttccatttgtttttaaagaaaagggtgtattttgctccctgtgagacagaaatgatggatggagtctgagcctagaggtcagaagactggtttctattctcagcttccagcattgatttgtgtggctgcaggctagttacttaaagtctttggttttacatccactatgtacaaaacttattttcctttgatatgtacccttcataagtggtaggtgttaactggggaatttaccatgaaaacccttgagattctcccattctggtactgcccaacctaatttccctaaacaggtaactttttttcttttttctttttagtttaattttatttattttattttattattattataagttttagggtacatgtgcacaatgtgcaggttagttacatatgtatacatgtgccatgctggtgcgctgcacccactaactcgtcatctagcattaggtatatctcccaatgctatccctcccccctccccccacctcacaacagtccccagagtgtgatgttccccttcctgtgtccatgtgttctcattgttcaattcccacctatgagtgagaataagcggtgtttggttttttgttcttacgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctttccagcacctgttgtttcctgaatttaatgattgccattctaactggtgtgagatggtatctcattgtggttttgatttgcatttctctgatggccagtgatggtgagcactttttcatgtgttttttggctgcataaatgtcttcttttgagaagcatctgttcatgtccttcgcccactttttgatggggttgtttgttttttcttgtaaatttgtttaagttcattgtagattctggatattagccctttgtcagatgagtaggttgcgaaaattttctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagtaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcttacctgattgccctggccagaacttccaacactatgttgaatgggagtggtgagagagggcatccctgtcttgtgccagttttcaaagggaatgcttccagtttttgcccattccgtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacatttattgatttgcgtatattgaaccagccttgtatcccagggatgaagcccacttgatcatgatggataagctttttgatgtgctgctggattcggtttgccagtattttattgaggatttttgcatcaatgttcatcaaggatattggtctaaaattctcttttttggttgtgtctttgcccggctttggtatcaggatgatgctggcctcataaaatgagttagggaggattccctctttttctattgattggaatagtttcagaaggaatggtaccagttcctccttgtacctctggtagaattcggctgtcaatccatctggtcctggactctttttggttggtaagctattgattattgccacaatttcagatcctgttgttggtctattcagagattcaacttcttcctggtttagtcttgggagagtgtatgtgtcaaggaatttatccatttcttctagattttctagtttatttgcgtagaggtgtttgtagtattctctgatgatagtttgtatttctgtgggatccgtggtgatatcccctttatcattttttattgcgtctatttgattcttctctctttttttctttattagtcttgctagcggtctatcaattttgttgatcctttcaaaaaaccagctcctgggttcattaattttttgaagggttttttgtgtctctttttccttcagttctgctctgattttagttatttcttgccttctgctagcttttgaatgcctacacaggtaattcttctgcattacacaatcaagtgtactctgtgtagccactaaacttcaagaaattgtttggattcagatgtacttaaatgataagaaacccatttataacccattcacaggcagggcctggggaggcaggtttctctaaacactttgcataaaattagacaagaccaagagagtttagacaaagctcaggctggttccatttcaaatctcagatccagtggacatgtgaatgaatacctgggattatgtgtttctggcatagaccaggcaatttcacctgccacacaactgtgcctaatgaatgctttcttctcactccgaatggatcttctgccacatctaaacacatggtatgattgtcagttgttctgttaccataaagttctgagacaaaacttcccatgtcaaaataaatcagtctgctaagaattttttggttcatctggaaaccttgggactgcctatatttccaggactatttaaaaatattttaaaaggtctgccaaaaaatgggaatatatgaagaatcagcatgataactagtttgaacacattttttatgaagcaaaccacagaatgcttcacagagttaataaaaacatgagtcctcagaactctttatgacatttgagactaaaattggcttcactttaaatcacagactttagagtcaggcagacctaggtataaatcttctatttaccttttacttgttgtgagatttttggcaaatgacttaacctctctgagcctcagctttctcatctgtgaaacggaaatgtctgcttcccagggttatgggggttaaagaatgaaactgtgaagaatgcaactagacttcaacatcagtcactcccaaggttctttcctttctgtttagaagtcacctctgtggaaaaagaaggcagatcctacacaggtgatgggattttatgctcaacctggacaactttcaatccttccttcttatttgtgtgcaagtaataaaattaaaaaagcttgagttccataatcaacacaaaacctcataaagcccagaccaagccattttctttcattctttgcgttctttctttctgctcatttgggaacatctttatcttgtagacacttcaagaaaatgacaggcaaccatggctagtgtggggacacaggactctgtaaagcgggagaaaagattccaagggtgccgttagcctagttctttctgccccttcagtaaaacagtgtcaacaacccttgcattcctgcagcttcaggacagcatcccgtgctcagaaggttccctggacttcccgtcctcccaagcaagttgaaacttttgtctttgttcatcagtgttagtgagtatagtctaaggaaggtagcacattagctgcctttgctttctttctccatcccttggtatcctgaggcgcataaggatttaagagttgctgggcacggtggttcaggcctgtaatctcagcactttgggaggctgaggcgggtggatcacctgaggtcaggagttggagaccagcctggccaatatggcaaaaccctgtctctaccaaaaatacaaaagttagctgggtgtggtggcgagaggctgtaatcccagctactcaggaggctgaggcaggagaatcacttgaacccagaaggtggaggttgcagtgagccaacatcgcaccactaaacttccagcctggtgacaagagcaagactccatctccaagggggaaaaaaagtcaactaacacagttctgggagctccatgacactgagtttaagcaaagtagaggagcccattgtagcctactctgaggacagcgttttatttccaaatattgttcttcctagatctagaagccaaactttctatattttaagctacatgtcacactcctcttctacaactaacattaattttgctgaggaaaaaatacaaatgcatggtactgtcataataaagccgctgccaggggaagagaacacagctgatctcctcctgccccctcacccttctgctcagcgcagctcagagcaatgcacacgtgtcagaggccacagagaaacctgcggccttcttttgtcaacatttcttttagaacattggcaaagatctcaaatgtcagtgtgtagaggtatgacagataaagatttgtaagtgcgtgtgtgacagagaaagaatatgtatgctcaatgaagaagctgttgtacacatggctttggagtctgtgtgaggacaccctcaaccctccaggtcagcctctggtcctcccatatgaatgctatcccttgattcccaccagggtcatccaacactggcctcaagccaactcctcctaggagccttttcgactctcatgctcatcaaacagctgctctctgaacacattctaaagctcccctgcagactggccacccacatctctctcttcacctccacatgaggaatagcagtttaatcatgcataagttaatatttctctgaatctgtgcttaactcccttagactccaggatgctgtggagtgtctgtcagtgcaaagggcatcatcaccatcactctttcctggctggaggtggagtaggggtggggtaaaatatgtagggctcctgtagccagggagaagcctgatgagttgtcattcctcctgataggggcacatagatcaaatctatgatggtaatagaagggaataagacacctaagctcataaagagaaagcagtcccaccaatcttgtaattaaagaatagcaaactaatacaacagtacgtgcatctctcacacttactacctgggtggcttgaaggaacctgggaaccctctagagcctcgtttgtcaacatgggaaataaagaacataaaaccaagcatatagacctgtccagagaattgttaatgtaaaacctggcatatcatggaggaaatggtggttgtaatgtccctggtcgtgggtacatcaatcatctgctgctattcttttttttttgagacagggtctcactctgtcacccaggctggagtgcagcagcaggatcacggctcactgcaacctctacttcctaggctcaagctatcctccttcctcagcctcctgagtatctaggactacaggtgcatgccagcacacctggctatttttttttttttttttgagatggagtttcgctctgtcacccaggctggagtgcagtggtgtgatctcggatcactacagcctctgcctcctgggttcaagcaattctcctgctcagcctcccgagtagctgggactacaggcacgtgctgccacgccctactaatttttgtatttttagtagagatggggtttcaccctgttggccaggatggtcttgatctcctgaactcatgatccacccacctcagcctccccaagtgctgggattacaggtgtgagccaccgcacctggcctgtattttttgtaagatagggtttggccatgttgcccaggctgatttcaaactccagggctctagtgatctgcccacctctgcctcccaaagtgtgaggattacaggtgtaagccaccacacctgctttgcaattttttaaaaattaataaaactgaaagttggccaaatttagggcaaacaagtaaaataataattatgtacactattatagaatgtgtaatcttttaagggcattgggtcatacatgctcagaattccccaaatatgatccatatcacttgtttcattgattatattctggtgaatttgtgataagaaaacaattttaaaatgccccatgtgtcatgattataaaactataataattaagacagtacctggttatatgactaagatcaatgtgtaagaatgggaagtctagtcacaaggcccacatatttgcagttacctgaaaaagtggcagtgccacgcagaagagatggttgttttggttgatgctaagccaggtgctaggccaactggatatccatgagaaaaaatgattctgaccccaacttcacactaaacacaaaaatcaatgacagatggagtgcagatctaaaatgcaaatggcagaacaataaatcttttagaagaaaatataagaaaacatattcgtgaccatggagtaggcacagatttcttaaacaagatccataagatgttaattataaaggaaaaaatgataaattagaaccacattaaaatcaagaacttctatatatcaagacatcattcggattgagaagaaaactcactgaatgagacaaatttttgaaaaatatgtatctgaaaaaaaaaaaaaacttgtatccagaatatataaagaactacaaatcatcaagaaaaagggaagactgcccactgggcaaatggcaaaagactggagcaggcacttcatgaaaaagggcactccaaagaaaaaatagacatatgaaaatatgcccaacaaggctggggagaaataggaacacttttacactgttggtgggagtgtaaattagttcagcccttgtggaagagagtgtggcgattcctgaaggatctagaaccagaaataccatttgacccagcaatcccattactgggtatacacccaaaggatcataaatcattctacgataaagacacaagcccatgtatatttattggagcactattaacgatagtaaagacttggagccaacccatatgcccatcaatgatagactggataaagaaaacgtggcacatatacaccttggaatactatgtaaccataaaaaagaatgaactcatgtcctttgctgggacatggatgaagctgtaagccatcatcctcagcaaactaacacaggagcagaaaaccaaacacagcatgttctcacttaaaagtgagatttgaacaatgagaacaaatggacacagggaggagaacatcacacaccggggcctgtcggcaggtgggaggcaaggggagggagagcattaggacaaatacctaatgcatgcagggcttaaaacctagctgttggattgataggtgcagcaaaccaccacggcacatgtatacctatgtaacaaacctgcacgttctgcacatgtatcccagaacttaaagtgaagaaagaaatacgcccacgaggcaacagacaaatgtgattaagaccacaggaaggtatcaccacacagtcattaggatggctaaagtgccaacgatgaaaagtatggacgtggaaccaatgaaaccttcttacactgctgaacacaccatatggctgtggcccagggtttagagccaacagaatcaaacaagtatgttcacaaaagacatgcgtaaaaatgttcatagtggcactgtttgtatagacccaaactggaaactacttaaaagcccatccgcagcagaatggataaaaaaattgcagtgtatattcacacatcgaatgctatgcagctgtgataacgaatgagctacaactacatgcaacacagatgaatgccacacacaacagtgaggaaaggaaaccagacatagcaggcagaggtcatctgctttagaagtcagtagttactgtcaagcaggggaaaggagatgtcaggggatcctctggtgctggtaatgctgtgtttcttctggttgcaaggtgtgttcagtttgtgaaaactccttgagccatatccttatgatttgtagcatttgtgaatccttatggtttgtatgcatttctgggtgtattctatgcctcaataaaaagtttaccctccaaagtacaatacatatgaagacacacacacacagacacacgtaaagctcactaacaccagattggagaagcagtttcaatgtctcagtcctaccctataactcctgtagaccttctagctgctaacgcacagaatacttcattttcgacacattctgccccagtttatcttgcatctgaatttccttattgtattatcaaataagagatatatatatcaaaccttattagtgtttgtttcccataaaatccactgctccatttccaggtctgggcttaagacgctgatcggtgggattgccagctgagcagatctcagacactccagctcctcttttggttgaatcagtgggtcactaatagttattgacaccaactgagctcaatatcactggtcatcattaccagtccacggaatccacagagacagtcatccacatttcccgttgtgattggtgaggcattagaaaggatagattttcacagggcgaggttgtgaaaatgacttgaaaaatctcagtggctaacaggtaaaggcatgtcttcctcgcaccacaggttctgctcatcttcacgatccaagaactcaggtgacccaggtctccctgtttccatcatcaagatgggaaaggagcaggtgctggttcttaaagcttctatccagaacactcatatctcattgacaaagacaagcccgagattctcctcaaggatgtgccatcctccatgaaaggggcgctgaatactgtggattctggtgcctcccaccgtgggggcagctagggggtatcagcaacaccggatgctgacaaaatcacattgattttcttcccaggtgtggtttggagagaggagcactttgggtaatgagggaaaggaggcacagccagccagccagttagcaggatcaaccctggtcctcagtgggtgatattccatccagtcaattatatatatatatataatatatactcttattaagtatatattatatattaagtgtatatatatatatatatactcttattaaggaacaaaagttgggccaggcatggctcatgcctgtaatcccaacactttgagaagttaaggcaggaggccttaggagttgaacttgagcccaggagttcgagaccagtctgggcaacaaagagagaccctatctcaaaaaaaaaaataaaaatgataaaaccagctggccatgatggcacacaattgtagtcctagctactcagaggctgaggtgggtgcatcgcttggacctgagagttcgaggctgcagtgagccatgattacacttacacttactgcactccagcctgggtgacaaagcaaaaccctgtctcaaaaacatatttaaaaagaagaaaagttatttaatgatatttgctatcactgctaaaacctggtaagaaagactttcttcaggatcatctcgacaggcatagggactactgcaatgggattttgcagtgtgggagagagattgggctgaactctgaatacaacctggacaagtgggaatttctagcccaggagcatggtgggggtcagttgatggaaaattacaaggaataaacatcaaggataaggggaattctggctaagctgacctaacgggtttcttactgaagacaggccagggtgatcagactatatctgtggaatggtggaggtggaagatcttgatcaaatatagacgagataatgagggtggggagttcttgctaaactgacttggccgggatcttgctaaactgaactttacaaggaagtgcacagatgggcccaggagaaggttcaggagcctgactaaagtttaatcaaaaaagaatctttgtcattctgcaagctcagagggactcttgggtgatcaataataatttagctccattttcttttgtttgtccaatgttgtactttaaagaacacctaaagaaaaaataaaatacaatcaaaatttggagaaataatttctccatgaagatgtgaagggctctgtatttatttaacttaaagacaaggaacagagtcaacagccattaagtaagtgacttgataatacataaacacatttcctcattcctcttagagatgagacaaaaagaaattatttatttaacagcagagccatcttaggctaaacactaggaagagctgactttgcattttattgtctgaggagattgtgaggtcttaacatgcccctgaatgtagtatcactgaattaatttggggattccctccccccatcaaatttggaaacatttattgaggctttgctcattatttagtaaagttaacctcctctttataagagaagtgtactgaacatatgcataatatttgcagttctataaagtttaaaataaaaaagaagtttatatcacaggtggcaggggctcaatataagttgttaattttattgagtgaattattttaccataaaagtatgtttcagcattttctagaaacccttattttgtctgagaatctgatagagctgctctcaatacttacatggctcagctggcaaagggaggacaaaatgattgtaaatagctttgcttttcctcactgaaagcctttttaggttttgaagcctctaatgaagggagaagacactggctccacactccaggtacagagctgtttttgataagatgaaaaggatgtttttcttaccaggtatcattctcttcagaagtaatgtttcctacacaaagtgactgcatgtcaaatgtgcaatttgtctctccagagcacagtgactggcttcttcgttcctgatataatggctagctctggatttttcttggtaatttctatatctctgttttcctctcaattgtaatattcctgcatcagaagacgaactcagaagttgtggttctgcgaaaaaaattagtttctactgtgaattttcttttcttatcaaattgtactaaaataactgttcacaacagtgtttcaccaaatcgttctcaaatttggtgaaatttcatttaattcttcccattgatttaaaacataaggtatattggatgcctaattattgctgcaattatgttctgaaatacataacataatattgaccaactatattttctatggtggtaaaacatagataatgcacactgaccattttaatcctttcaaggtgtactatcaagctgtggttttctttgacagatgacaccatcctacagcgggagaccttctccccggttcacaccaggactccagaaaggacaccccagcgtatcctactgtggagcacataactggatgctaaagaagaggtctgcattaactgactgcccagcagctccttccccagctgagctcattgccatctaatccattgcaaatatacaggagcgtgccttggctgtctctttcggagtggagaagcttgacatttggatacgattggttgcagaagttaagaactaagtttcacttctttatttaacctgaaagttctcttaattccctgcatcattgtgccaataattctgctttctgagactttgctggatgaagaagacatctggatttgattttagagaaagaaaaagccaagacaatgaaataagtgtgtttgtaaatgtaacttttaggtccgttacatggttttgtcctgtttcttcccacccccactcccaattccccttcctgttaaaacctcaagtcaaatcacaaacctatctggctgctttcaaatgtaaaagaagactttacaccaaaaatacagacttctctaatggtctaaactacaacttcaaaacttaaattgttcctatggatgcaaatgcttaagaaattggtcgtaaaataatctctctttaaaatataaaccttagcattttataatgacaacaaaccatgtttctcattggcaaaagcactgctgtttctaagtctctcgtctcacaagaatgagagcctcactggtctccccccagcacctagagcaggacctggcaaagagctggccctccttcaatatctgcataatgaataactctccatggaaaccagtgccactgtggtcagtgacaacgtgctgtaacttactccgaagacagcaggggcatgggtgacaccgggagctcaggccatttgcaccaggctctctctgggtctttgtttatgccccttccccttcctcctcctctgtcactggcctctccatatgaagtctctccttttctttccctcctcaccatggcctttgtgccttttcttctccttccctttaattcccactttcttcctttgagctttctcttcccttcctctcattttccattgttctcctcccctttccaccttctcctttatgtagtaaaaacatggatctgacgtgtattttaaattggcattttaatatcctatcagcttccattcttcatttttctcatggagcatacaaattgtataagtgtttacctggcaacaactatgttttgcttgtttgtggcaaaaaaaaaaaaattgccacgatgacaagtgcctcttgccaagtcgggtgtgcaggtgcagagtcacacccagccgccctcaaggtccacacgttgcccagtcatctggcggttttctctctaacccaagcatcctggtgcctgcgatgaggggaataggtaaccctattgctacactcccagcttatgaagaacacagaacacagagctcaagggaaaagagaattcttttggagacaaaagataattttgtacttctaatctggatccctaaggtcgtgccctacctcccctatgaccatccccatctttactgaagtataattgactaatacaaattgtatatagttacggtggacaatgtgatgttttgatatgtgagtacattgtggtatgatcactataatcaagctaatcagcatatccatcacctcacatagttgccttttgttttttgcctgtgtatggtgaaaaaatttaagatctactctgttagcacttttcaagcatacaatgcagagttgtgcccttagttaaaggactcgggggctttgtgaggtctgaatcctattgattatccagtgcctgctttttcccccttccagtttttctgttcagttaatgttggtgccacatacattaaattgagtatgtggacagcagagtgcagttcctgaataaagagaatatgaaaatctattacttattgcttaagttaacaggaataagtgttaggcttatttctgattctataggacaatcaatacctgtttttatcaagtacctgcctccttaattaagagcaatagctgacaaaagttaattagcaatgtcaacatgaccctatcacgttgccctgctctgacttcaaagaaaatttagataatgttaaaggattagaaaagaataacagaaagtccagcatgcctactttaaaacacctgagttttcaagttctccagatataagttatatataactttttattatataacatattatataatctgagggaaaaaaaatgccacgatgacaagtgcctcttgccaagtcgggtgtgcaggtgcagagtcacacccagccgccctcaaggtccacacgttgcccagtcatctggcggttttctctctaacccaagtatcctggtgcctgtgatgaagggaataagtaaccctattcactcccagcttatgaagaacacagaacacagagctcaagggaaaagagaattcttttggagacaaaagataattttgtacttctaatctggatccctaaggtcgttccctaccccccccatgaccatcccccatctttactgcagtataactgactaatacaaattgtatatacagtggacaatgtgatgtccctctttcttcctgctaatatcacatacatttgtactgtttcttttgaaaacttgtagaaaacttggaggggaaagcatttctagcctctcctgttggtcagtggattaatttgcctccagtaagtgtctctgtggcttactgtcattcagctgataccgaagctttcccttcctggatgctcaggacatgtgatttgaggataagtttacctgggcttttcaggcatctttgtttgcttcttttcattccaaagcttttgctaggaacagggaagctgacacatcagcaggcgaggacccttcaatagtgtggagagtgagggaaggttgaacagctagagaacacaaagggaagaaaataatatactttgccatttctataaccttaatacaattttaataaaatttttctttggaggctttaaattcatttctttaagaagctttgttgagcaaaaatattcttacaattgccattaagtgcaccattttgttcaagatgaacccattaaactttttctttatcataattaagcccaatatgccaaatgccaaagattagctatcagcttagtacaaaccaggaagctgaagaatagctgtatattcattaagccccaaagagtgtgtttttgttttgttttgatgctaaggaaaggcaggtggctcaaacccagggcagtgtctttgtctccacaggataagcctatttaactcagcttagttcatatcttcagatgcaatccttagcagaccagtgacctcggggaaccctaaagccagacagaccacctgcaggggagagaagcggatcagaggaaggtcacaggtggcatgagtggtgggctctgacaggaataagcccgttaatgggctgttatggaaggaaagctggtcatctggcctcccacccctggccaggagaacctggactgcagtttcaatctcactgcatgccatttagatgtttgtctgcagtgctatctgtggggttcttgaacttgtgacttttaaaagacaatacaaggatggactggtaatgactgacatttagttgaatgaaaattacccagaagtttaccaagcaataaacttcaatctaactagatacccaataaactgtatacaatatgcaaatgcagaattgactgactgagaacattaattattttcctgtggtccaattatgaaaggaaaagaagcttttttactttgctcttttcaaatgcaaagtggttattgggagaaaaaaggctggattcttacaagtgaagcagtataaagaaggggtaggtaaaggagagtggacgaacctactcagagaaggattcactgggcagaggaggggtagcaatgggggttctgctgggctggagacctggactcccaggtagcaccccacttgtgactcacctatgaaggtagcttgtggtgacttgaaggcttatctctaggagctatgacctttgaggctgcatcaaagacccaaattatcaaattagtcacaagagagtagatgccgtgaggagcaggttgttctaccatcaggtgggctatggaaaagtcagcaaacatggctgatggaccaaatccggtcagcctcctgtttttgtaaataaagtttcattggcacatagccaaacccatttgtatacttatgacctatggctgttttcatacttcagaagcagagttgagtagttgtgacagagaccgtatacatagtctgcaaagcccagattatttactagctggctctctactgaaaaaaatatgctgacctcggaacagttagtgtggactgtgggctgagagtagattgcacccgctattctccccttaccctgcagtcaggagatcctttgcaaattttctggagcccttaagtcctccaggatagtcaagtgatccgaggccaatgaacgatgactgatatcacatatctcttcatcttcccaattcttgccagcttagttccagactgaagtatgagatgatattttatatttatattatgagcactgtaacacaaatttatacctcctaggtgcgtcattggtttcctattgttgctgtaacaaattgccacaaactaagtgacttaaagcaacacaaactgattatcttacattttgcaggttagaagtccaaaatcattctgtgtgaactaaaaatcaaagggtcatctgggctcggctcctttggaggctctgaggcggattcagattcttaccttttagaagcctcctctagtcctcagcttgcggccccgtcctccatctccaaagagacagcatcttctctcctctctgacctctgcttctattgtcacatcctctttgactctgatccccatgcttctctcttatcagggcccttgtgattgcattcaacccacctggataatctctctgtcttagatctttaatgtaatcatacctgcaaagccccttttgtcatgtaaagtcacattcccaggtgctagggattagaacgtggaagtctttgaggggcgtcattcagccagtcacacatagagaactttgaggctttgataccaacttcaactctataaagaactgctgagaagccatggctatctagggggaatgggactattctggtcctgtctagagtctctactttctattcattctcaactctcattcaggaaagggatgggtggggaacagcacagacagtcactggttcatagctcttatcagcactgcctgccaagcgagattggccagggacccagccttggcaacggagtgggcacttggacaaccttatttagtaaccttggaggacccctcttgtcctctaccgccctgactcatatttccactccctgggaggggcttccttgtctacatcatgttcctccatggccataccttaggtggacattggggagaatgcctttctaggggaagcaggtgtaggttttgcagtgcagtacttgttgcaggtttagggatcaggacactgctgtgaggggtcaaatactcaaaggctatttgtgaccagactccaactagtgttacagttttcctaaaaaaaaaaaaaaaaaaaaaaaaaaaaaaaaaaaaaaaacgcttctaatttgttatggactgaaatgtgttcctaactcctagtatctcaaaatgtgactctatttggaggtaagctctttaaagggtagttatgtcaaaatgaggttggatgagtgggctgtcatccaatatgctggcgttcttataagaagaggagattgggggggcacggtggctcacgcctgtaatcccagcactttgggaggctgaggcaggcggatcacctgaggtcaggagttcaagaccagcctggccaacatggtgaaaccccgtctctacaaaaatacaaaaatcagctgggcatgaaggcaggtgcctgtaatcccagctactcgggtggctgaggtgggagaatcgcttgaacctgggaggctaaatttgtagtgagccaaaattgcgccattgcactccagcctgggcaacagagtgagaatccatttcagaaaaaaaaaaaaaagaagaagaagaaggagattgagacactaacgcatgcagagagatgaccatgtgaggagaacatcagaagaagatggccacctacaaacaaggagggaggcctcagaagaaaccaaccctgctggcaccttgctctcagatttccagcctccagaaccatgaaaaaataaatttctgttgcttaagctgctgaatgtgtggtgccttatagtggcagcctgagcagactaacagagattctaagcaatgggagctccgtaaggtgtgtgtgttgggggagacatcagagaattgttagcagccgacactcacagcagctgggggcactggcccaggaaagggcttctgggcagccaccaaaacagcatctaccccagcgggcaagtccccagtcacaaaaagacagtgcagattctggagaatcaaacagaataagagctttcgactgctctatgctatgaaacacaaaaattgggacaccaccagaaacttttgaagttggagcttgaagtctctttgcaggcagaatatgttttgccttaaaaatagcacccaatgataacccttatcaacatccattctgcagataacaggcctccctcagggaccatataggtgccattctcccctaaagtcaactgcagcctcaaagagccattgaattcataaggcagcatggagatataggtcatgttttcttccctccaaacctagaagcttgtaagggtacatgctctctagacacaaaataccatatttcctttgcatcttaatccactcaaccctggttgcagtcaccttcttattattcactccatacaagatagatgaattttcacgattttccagtttccgttctggttctcctgttcctggtaggacaacagagaatactatctttctctttcttcaaagattctgtcctgtgagaatgttcctctccagtgatctagtataaactgcaccatccagctctactcatgatttcgctgaccatagattctttgtgacatagtttcttatttctcatttctcctgtgatgttataccctttgtcaagcacagaagaaataatggaaactacattcacctttattttctatgcttgatagaactagtggtgtatagcagttggcatcaaaagatgaaggtacaataagacatttgattagtaatcaaagaggtgaatgaaataagatggaatgccaagttacacagtggtataacccaatggtgagtcggatatgtttttttaaaagcctacacattttcttctgcataggacatcagacaatgaaatacaaacatgtagagtttttttgttacaatcaaagctagaaaagtttagggtattttcttagtaaagagtcttcgtatggttaggaagaggtcttcaggcaaatgtaccatttctctataggagaaatagctctttcttctaacaactgctgaatttagttttcagatattaaatgtgtataaaccgaatggacatccatcaaaaggattgaattggtgcaaaaatgagtgacttttgggcctctctttatggttgctttgagaactgctgcatctaaaagtggactacaatggaaggtgtagatccagcagaggaacacactggggaataagaggggcaattttaagcatgtaggtgatctcaagtaggctgatctcaagtaggcagaccacaaaggatctgaagccaccaacaatgttgagcaaagatgtccagagacacttacgcgggtcctgcattgatggtcatccttgcaggtctatgggtggggtagggctatgggaggctcccagttcaataaaatgaggcaagtatagagaagagggtctctgttattcacaggaccattattgaaatcagttccagatatgtttgagtaataatagttcaacaagagatggattccatgggaaagaaacttgcaaaagactaagaagggaagcaagtctatcaatacgcaatcaggactgtatcccacaaacgaatgctgtagttcctctcttcagtcaggacttactgaggatttgctacatgcattcacgaggtcagcacttggcatcagttgagcagtatcccttcagcagtatccctgaagctaacgtttcagtgggagagcaggtggtgacccttctgtaaagcaggtgaggggctgaagaatggagaggaagggggtggagttttctacagcgtgttcatggaaggcttccctgagtgatacagtgaaaggaaatgagtcacgcagagatcttggggtgagatgggaggaagagggaatattccaggcaaagagacagtgacagttaattttaggtgtccacttaactgaattaaggaatgcctaaaaactggggaagattgctttcgggtgcatatgtagggatatttccagaggagactggcatgtgagttggtggactgagtggggaagggccaccctcaatgcatgtgggcaccatccaatcagctggaggcccgatagaagaaaaaggcagaggaaaggtgaattcaccgtctctcctggagctggggcacccttcttctcctgcccttgcacatcagaattataggctctctggccctccttggattctcaggcctttggcttcagacccagagatacactactgacttccgtggtcctcaggcctttggacctggactgagcttggtttctctagttcttcagcttgcatatggcttattttgagacttctcaaattccataatctcatgaggcacttcctttaataaatcccatctgtctgtctatctatctagctaaatcttcacctatgtttattgtattgattctttctggaggactctaatacaaagactaagtgcaaagatcctgatgtcacaatcagagttgcaagttccagcaacaagaacattggtgaatctgggacgggtattgaaggagatgatatcaaagagacagacagtggctggacatgtgcagctctgtatgggactcccacccttcatgggatggaattccacccttcattgtaggttttgtttagggaagtaatgccatttgatttctctattaagaaggtggctaggtggccacagctgctcataaaatccattctgagatcatcaagtgtaaaacccagtgcatttcatgaagcgttttacttgatgctcacggcaaccccataggagctcacttattatatttttgcctggagtcacacagacagtgaccgaatttggagtcaaaccaagacttgtagaatagccacagtactgcattgcatcacaagggagtgtgggtgaacgggcgagagtaactcagcacagagaaaattagaaagaagtgaggtccaagggttggcctcagctgccatcaccagagagcactgcagtggggattgggacctgaaatccaggaatgggctctagttccattagctcatactagtttgttggctgaggcaagccatttaaatcaatctggacctgctgcttcacaaataaggttgctgaactccaagaccccaagttacattttgctctcggtgatccatatactgtataaatgaagtattacactatcaaaatattttatattgaattttattatggtttattaggttttatagaattaaaaattataggagtagaatggtctcaatcagctcattttatttatttcttagccttatggatgaaaaataatgaaaaccacaaataaataaaaataatatctttgcagccaggcgcagtggctcatgtctgtaatcccagccctttgggaggctgaagtgggtggatcatctgaggtcaggggttcgagaccaccctgtccaacatggtgaaaccccatctctactaaaaatacaaaaattagctgagaatggtggcacacatctgtagtcccagctactcgggaggctgaggcaggagaatctcttgaacccaggagacagaggttgcagtgagctgagatcgtgccattgcactccagcctgggtgacagagtgagactccatctcaaaaaaaaaaaaatcattgcaaatatgtattaatatacattgcatacacagacatgtttcatataaagacatacttgtacacacatacacatactcccccagccaccagtacttctgtgtcataaactctaccccagtgtgactggtgctttctggagctccaccaaagagttcctgccccagcaatccctgattttaccctccggagacaatcactgtctaaataggttggctctatctcttgtggacacggaccaagtttactaacttctcagcatcttcaaacactcttgggtatgtctggggaatttctagccttgtgagtcccaccttcccaaagcagaccccaaaggactcagagttgcaactttgacagctgggtcgcaggagttttcaggctccaccaagctgatcctcacaccctagaccctcccttgagaaggatcagcctgaggaaggaggctccaccgggatctacctttggtggaggcatctgactcctggaggtgacagcctgctgttctagccactggagcaggtgcaccatgggacgtagggtagcagcagctgtgtccaagcttgacatcagggcaaactgtagcatcccaggcttagtgacagggggtagggggactctcactgtcaggccaattcctggaagcagagagcctatttctctaggcctcttaaggatgtcgtggacaccccagtctactctttttcactgaatccaccataatgaactatttttcacttgtaactaataaaacggtgtgatcctgactgcccaatacttgttgaaacatgtctccagagcctatacacatttaagcaacatgtatttttatacttaacaatggaactcagctgtacacactggaaagcttagacccattctttctttttgactgccccatggtatttgatggtattgtattggtgaagcatactttgcttaacaagccccctattgctttacatttaagagatttttcttatttttactgttctatacaatgtagcctgacacacatttgtcgttttcaattcactctgtggctttcgtacagattactaaacagtaagattgctgaaagattatatatgcacagtaaaatttttaacatataaaaacaaattttattttcaaaggttattccaatttatacctgcattaaatatttatgaagacaccaatttttccccacccttgctaatacttgatgttattagtcctttgaaatgttgccattttgaaaggcaaaactccacctcattttaatttatatttttaaatttattagtgatttttagcatatttttacatatttactggccatttgtatttttcttctgttttacctatttatatttgcccattttctatttttttactgacagagatcacattatatgttgtacataataatatagcacatattgcatgtaatttgtgtatattctgttgcaaatactttccctaagtctctcatttatcctttaattttattagggtattttctactacacaaagttctatttagcacttgctggagtgattcaactttagaggatttaacaatataattaagtaaattaataaataatttgagtaaaaaaaaatcacatcaaatacaaaggaaaaaagaattattgaattgagacaaaattgttcattaaaaactttaagtaaagtaaaacgtttgattaaatactttaggtaaaactttaaaaaaacttcttaagatgagtttcgaatgctatcagaagtcattatgaaaacattactctaaactggaaaatcctcaatgcattctgactgaagttggaagcaggacgaagtgtagggtatctcctcactataactcaattgtgttcaggaggttttagctaatgcaatcagatagaattaagtgactgatataaactgaaagagagataaaagcagtatcactctttgcagataataagattttactcctagaaaatgcagggggtaaaactaaaagaaaaccttttagaactaattttcctttcaaaaatttcacaggaaggtgtcactgtgtaagtagtgactttgaaaccctcaacagctttcctctatgctagtagtaactatttagaaattaaaatggtaaaagtttctattcatgacagctactaaaagtacaaatggccaaaaataaatttatcaaggaaaatacaagagtagaatgtatatttcaatattaatattttactgaagacataaaataagattccagtaaatggagacatgtcatattcctgtatgggaagactcaacatcacaaaagcttctcaaatcaatgtataaatttaatgcaattccaatcagaattctaatggattgtttatatattctggtcctgcttttgaaactgaataagttgattataaatttcatagggatgaattaccttgataatttctgagaatgttttgggaaattatttttcagatatttaagtgtatgttagagctactctagtcaaaactatatattactagtataggaacagacaagttgatgaccaaaacagaacatagagtccattaaccaatcccaaaatacgtgttttattatggtaaatgatacttgaacaaatagctaatagtttacaagaaaaaatatgcatttatgctaaattaaaaaataatttttggctagattaaagatctagtgaaaagataaaatccatttaatgttatagtaaaatataggagttatgtttttgttgttcagccaagtggggaaggtaattctcactaaatctgataacctggaagacatgcaaaaaaacaaaagaaaaaaaactcaccagatctctttgattatatattaaccccaccatatgataggttaggatataagacctataagtgggaataagtaactcatgcaagatcactggacttggcagagagacagaataaagggctaatcagatggtcagagtgtttaagtggtatgagctacacacttttctctttcccagtcgttcataaactttaatgaacattaaaaaccacctggagtgctcattaaaatttacctgactcccactcccagtttctaatttaatagatcagattagggactgaaaatttgcatttttaataagttcataggtaatgtccatgctgcagagtgtagcatcacttggagtaataatttgctatgcaacttccttcaacaaaaaatcatgctgcatacacacccacacacacacacacacacacacacacacacataagcttggatgtcatcaaagagcatacattttatgccgagttattttaggggtacatccatgttatgggctagggaaaacttagtctgaggggtgaacaggtagaagggtcaatgtcaaattccatcagggagagaagtatcaggtcaggttgagattacataaaaacaacataattaagacatttcatttatcaaaagaaagttataggatattagtgaaaatggcagtgcaatgacgttcaaaaatctcttctccataaaagtgatgagaaaactggtaaaagttgttggaaacaaatttttctgaactctggaaattaaccaaggcttggaataacctggagagggttcattcaagaaaaaatggctgaatttcaggaaggccagtgagcttagggcattttaatagtctcattccctgctctccaggtgcacagtaatcttgtaaaataaaactctgcattcctattgcagcctggcagaacccccagaggtaacagaatgaagctggagatcttacaaagctccacttccaaataattgccctttaaaaagaaacctatttcatggtttcctggaccgttcccacttacaaggctgtctgtatctgacctgacttagagactgcccaatacaaaaagccttctccccaaggaacatttgttgagaacaattaataggcacatattttaactttgtaactgcttgaggtggtgaatagcagttgaaacaaccaataggctagccaaaaaagctgtaaaagaaaagctggggcatgagatagtcctaggacttagaaaatcctgacctattcctgggaatctagaaggtcatgtgtatgtcaatattggccacatgctccaggctgtgtgcatgctgaggaaagacctgagaaggtcctatgctctcacctctcgctgaccttgaggctctgtgaaagcagaaagggaaagctaggcaatattgtcaactgcctgactgagtgttgaagaagtgttctaacacatgaatatagctccttggcagaaacagaaagatttattggttccagacatttgaggaaacctctatctaatcattagctacagagacttcagtagccacacatggaaaataatacagattttgcagaattagtttagaaaaatccctaaataaacaaaaataactaacaactacaagcagcaatagctataaacctggagtggggaggatctaattttcatgattgtcaaattatattattttaaatgtctagtttccaacaaaaattgtgagacatgcaaagatacaagaaagcatggtttatatgcagttggaaagacaagcaatcagtagaaattgtctctgaagaaccccaaacgttggacttactaaagaaatactttaaataagctgttttgttcaaagagctaaaagaaacaatgtgtctttgcttgaacatttttgaatatgttcaaagagccaaaagagacaatgtctaaagaactaaggaaaagtatgatgtgtcagcaaatagagaatattaataaagaaataggacttttatttggaaaaatcaaatagaaattctgcagttaaaaagtacaattaatgatatgaaaaattcactagagggctcaacagcagagatgagcaggcagaagatagaataaatgaacttgaatatagtgaatagagattatgaagtatgaagaacggaaagaaaacagaacaaagaaaaatgaacagagcctcagagatctgtggaacaccgttaagattaccaacaacatatgaataatgggaaactcagaagaactggagagaaataaaggggcagaaagaatatttgaagaaataatggctgaaaacctttccaattcgatagaaaacatttagctacacagccaagtagctcagtgaattgcaagcaagataaactcaaagagatccacaagtattcataatcaacctgccagaacccaaatacaaagagataatcttgagagcatcaagagagaagcaactgatcatgtacaaggaattcttatttagattacaaagagataatcttgagagcatcaagagagaagcgattgatcatgtacaaggaattcttatttagattacagctgatttctaatcagaaaccacagagaacagaaggtaataggatgacatattcaaggtgctgagagaaaagaaaatgtctaccaagaattctatatttcgcaaagctatgcttcaaagataaaggagaaattaatatttttccatctttaggaaagctttgtatagccaccatggctctgatctcatcttgaattgtactgtcataattcccacatgttgtgggaggggcccagtgggagataattgaatcacgggggtggtttccctcatactgttttcatggtagtgaataagtctcacgagatctgatggttttatcaggaatttccacttttgtgtctttctcattctctctttgcctgctgccagccatgtaagatgggacttgctcctccttcccttccaccatgattgtgaggattccctacccatgtgggactgtaagtacaattaaacctctttcttttgtaagttgcccagtcatgggtatgtctgtatcagcagcatgaaaacagactaatacagactcactcctgtaatctcatcactttaggaggccaaggtgggaggatcacttgaggtcaggagtttgagaccagcctgggcaacatagtgagacctaaattctataaaaaatttagaaatagctgggccatggtgttatgttcctgtagtcccagctacttgggaggctgaagcaggaggatcacttgagcccaggaggtcgaggctgcaatgagccataatcaggccactacactccagcctgggcaacagagtgagaccctgtctctaaaaaataaatacatacatacagaaataaaaattaaaaaccaagataattagtcactggtagacttaccttactagaaatactaaaggaagtccttcaggcagaaatgaagaaacactaggcagtaacttggattcacgtgaagaaataaaagagcgacagttaaggtaataacacaggtaaatacaaatgacacaatcattgtaagttttatttgtaactcttttctctgatctaatttaaatgacaactgaataaacaattataaatctgttgatgtataaacaatggataaggatgtcacttgtgataataacagcacaaaaaaggggcagacaatgaagagcaaagtcttgtgcactgttgaaatgaaattggtatgaatctgaactagtttgttataaattaagatgtgacttgtaatccccagaacaatttatatgaaaatcactataaatatatggtaaaatacatgaaaagaaaattaaatgatacactagagtatatttaacaaaagaaggcaggagtaaaggaacaaaaaagacatgaacatgtagaaaaaaatagtgaaatgtcagacttaaagacaaggtgaacattcttgtctgtggtacaaggactgagatggattgatgcaaacaacagcttgccaataccaggagatcaataggagtgaggaaggagcaggagagaaatactcctagaagcaaatccatggtggtaaatcctgtaccctcgaccccaccaggtagtcccatttgtccgccctgcaggctcttgagctgttcctacctgctccagggttggctcccactcagtagtgggtttaccataacaagaatgaagcttacagtaggagacttccttcagagattcagggatgtggcagattcagtcactggccaggtacatggagctctgccccagcccagtagtcaccattacattttgctggtgagaggctacaggaaaggccagagcactggcagcattgccttgcatcttgcagccccagtggcagcctgccccttttggaccgatggggcatcccgagcctgtgactgacttcatggagatggatctgaaggatgctgctcttctccctgcttggggtggaccactcctgcaagagtgagaaggttagggcgagggtgtgggaaactggagggtcacatcctgagagattggaaaattaaaggcccaagctgtctgagggcttggcctaattctccatctcccccaaccccctagagcctctgctcccactagaggctctgagggcttcctttgactctgcacccctctctagtccccaaagaagaacccgctgagcaagaaactgcacagaaagtcaccattgtggattaccagttatgagaggcaaaactgaaagaagcttttctaaactatcaataataacaaaaattctgtcaacactgctagaggaaagatggaattagctttctattctctctgcagaaaatgacattacaaaaccgttgtcataggaagaggcaataaaagaatatgcaggaaaaaaaaaaaacacagagaaatgagtattaccgatttgtgtcaggcagtcaatgacaactgctaacaatttcatgttatttttctggatttaaggtatctatgatatttggtagctttttagtatttaaatttgcacgatttttttcttgttcattatctaattctgtattctttttttttgtctaaagtggcttacaaattgcataagctttagaccgcaaacacctccagctgggcctctacccactgctgatagacgacccccaaagaggccacaggggaaagcaggcctctcgtctcagcagaatctctcagtttcttgttatgtggttggtcagtgtaatcacttttaatttaaaaaacattgtacctcatctgttttgtctcctttgtagtcacacatataatttgtttttgtcttccttttcttcatttaaaagccttatcagaagagtattatttttatttatttatttatttttttgagacggagtcccgctctgtcgcccaggctgcagtgcagtggtgtgatccggctcactgcaggctccgcctcccgggttcacgccgttctcctgcctcagcctcccaagtagctgggactacaggcgcccgccaccaagcccggctaattttttgtatttttagtttattttatgagattttctttaaaaaatgttttgcttttgtagattttgtttctttgttatctaattcaatttctactattatcctcttttactctttctgccaaaaaatacagaccagattttaaacatcaaaacaaaaagctatggctacagtaaggatgaaggccaagtcttcactcccatggcaattttctcctagctaaggcgaggtataaaacaaattaataactgaatgtataatttattgtcaggtagtgattggtactgtgaagaaaaatacatgtaggtaagtggatatggaatgatggaggtggcatctgctttagatgggatggtcagggaaggactttcaagaaagtgatatctgagcagagacctgagtaggtaaggaagagagcaacactgtgtgtgttctgggcaaagggagagcaagtgcaaaggccctgaggtagaaatgggattggagtgtcctagtacttgcaagaagggcactgtgtgccatgcagatcaagtaaggaaagcagagagagaggttccagagctcagatcttatttaaccctattaactatagggagagtaccatttttattctaaataagaaagcaagacaacagagagtgtggggctggagagcgctgaggcagattgacgtataaatctacaacaactgctggtaggaaaacctcccttccatttgattccacttctcagaacttgcttgttggccccagaagcacaaaggagctgggtcccaccaggaacagctgggcagcagtgaatgctggaaaatgagagaggaagagacagatggatgaggattagaggaatcctccaacgggtccagctttgaatgaggcagaaagtgtgaaggtgaatggagagtcactgacacagggacaagttctaagacttggaaaaggaggcagaaaacacagcagaagttagaaggagtctctcttttgcctttattattcatttgttccacaagtaacacacgtcatttgtaaacatattagaaaatacagataaagaagaaaaagagtcattttaaattgcaaatctaaagattgttaggttaaattgcaaatctaaagactgttaatattttggtctgtacagttccatctttcttacacatttacacatatataaacatgtatatatatatatatacatgtatatataatgtatgctttttacacaaatcatatttgcattatactgtcatttttgcattaaatattttataaacatcctcatgtcaataaatgtaggttactattaacattttcaattagtgcaggaagactgctctgtatgtttttactatagtttatttaaacacttccctggtcatttaggtttttttcacattttgccttcataaatggccacgtaacagagctctctaaatttagatgctgggcacttgctgtttcttgatactaaatacttagataggctatcgctaggttaaagaattaaagatttcaaacctctagatatatcagcaaatagttctcaaaaagtcttgacttaaaaattcccccaacatgatgttcctactacccccacaccatcaccagtactggctacttcattattttgcatttttgttatctatccggtcaactgtgacactacttaattgttgtattagtttttatttttcttactaattttcatgtacttattcatcttgctggaactgcctagttcatatcttttgcctactgtgttgagcaggcttgtctttttctcattgcttttgagagttcatattatgtttatagtaattctattacatatgttatggtggtttcccaatgttattttatttttttttaattttttttatacagagtctcactctgttgcccaggctggagtgcaatggcatgatcttggctcactgcaacctccgcctcccaggttcaagtgattctcctacctcagcctcctgagtagctgggactacaggcgcccgccaccacgcccggctaacttttgtatttttagtagagatgagtttcaccatgttggccaagctggtcttgaactcctgatctcgtgatcttcccacctcaacctcccaaagtgctgagattacaggcgtgagccaccatgcccggccccagtgttctattaccatggtgagattttatttccctgtagagatagttttaaatttttatgtaatcagacctatgaagtttctgattgtaatgtccaggttggaaagacttcccctgccccaaagttctatcaatactcattttatatttctggtaaagatttatatttacattttaactcagctggctaccctagtcctactagcattacagtgagaaacaatttaaaaacaaagtcacccagttccactagcatccctccttacaccaacattccctgttccaccagcctccctccttacaccagcattccctgttccactagtactccttgcacacaagctctcctcctgactcctttttctcgtagcttatagagtggcctgagagtaattaatctctggctctgagcacagtgaggctcagcaggctccaatcacataaggcacagtccctaaggcttgcttctatctctcctcaggggagggctgtccccagctcctagagcggccccttgtgtcttctcacacacacagggaggaaggagatgaaggaatgacactcctcttagagagcctgcctatttggcttgacctttccctacatctgtctaaagtactgatggatggccgtactggagacactgttagactctcttcagaagactgtctggaccaccagtgacccttaacacagacaagcatatgctgtggaagagtagcttctagacttttcttcttcctctgcagccacccccatttagtacatgccaccagaaggcaatcagggtatcaaatcattctgtttgagctttgaaaacagtgctttttaaaactatgaatacaaggaagaggtacacttcttaatccccatagaccgttgatcttcccttgagatttctgttcaaatgtcactgtgaattttctactccctaaatttactaaaccaacagcatcccagcacacatgtacatactcggtattattgaaatgctgtcactttggggatagagcagctgtttcttacaggcagtaaacaatggttttgaacaggaagcaggagaaaacatgtccggagaaaactttctgggagaaaaacaaacattgactaagtttgattctggtcaagtgacacagttttatctagaaagtgatatcgcagaaactccatgttctaatatttaattatatgattaatacaatggtcacagattacttaattataaaattgttagtctgcatatttactggtccatttgtaaagtaaaataaatgagttcctctatcactgtcgttctcaaaggcaggggtagggtggggtggggggagcaattttgcctgccagggacatttgacgatgtctggaggcattttttaattgtgacaactgggagggtgctactggcatctagtggctagagaccagggatattgctcagcatcctacaatgctcaggacagcccctgccgctgctcccatcaaaacaaagaatgaccagccccaaatgtaaatcgtatcgagagaaaagtgatcaagaacaattaggaaaggcatctcctacatgttctctctgattttctcccagtttaatgcaagcagaaaaacgttgacctatgcccagaaggacactcgtgacgcaggaaaaatggaaccctaggaagcaggaatcattgccctgctgatgggaaggtcctgggaacatggagtattagaactatgtttatgggggcctagtccagtccctcatcccaggtcttgttccctccatgtcatgacttcagtgccctccacactgtaaaattcaccagtgaacggcacgtgaaaacttccaggctttctgtgggtcggagcatgggcgcatgtcccaagtgctgttgaaccctggtctcgggtcggctcagctcaagctgctgttaccacagctccatcttcagctccttaacatgctcttcctctctacctcctttcttcttttcttctcctggttaagtttaagaacctgcagtcccatccacccctgctccaggaaaacctcagcaacacttctctggtctactcaatccctcctttcctaggggctccttctcttcatctgtgatctcccaggaagcaaaggttcccttgaacccatctaccatcctcttcccaagcctccaactcaccttcttgcaaacatggtttcagctatctcctctgtcattgataataatgtgtgtcacacactgtgctaagaatttgaccctcaatacccttaggaggtcaacattgctattcagcccatggtacagatgagtttgaagacctaggttcaaaccgtggctgtggcagtcactcagcctctgagtctcagattccctatttgtaatgggaccaataacatcttccttgggactcagggttttaaaatataaagatcaagtgaattaaagcacattatcatcatcatcaccacgagtgctttaatgtattattgattcaatattaatttctaaagaaaccaaataaggagacaaggtataatcatttaacatattcctgactttctatctgtgtcaagactttgaagaaatcacacacagggtctgtttccctatgcccagcccagcaacgacaagccctcagggcagggactgtgcaatctgatcacctgagccagaatcctgatggctgagtgattgcaggcaaattataccttccagtaaccctgtcttcttatctggaacctgaggatgaaaataaggatgccctccatgctgtttggaaattcattcaattaatctttgcgatgagctgaggacagagcccaaaccatattacacacaaggtatgttgccaatcttaccacacctccagggaggacttgcagtaagtaacatcgctctctgaaacacccatgcttatggctatgagccatctctgtctgctgtaagccgcccccaagtctctggcctctgctctgcctcttggagtatttctgtctccttccatggccaccctggccagcatgcactggcatcccccatgtgccaagctgcatgccaagggcagatgtggaaggtccagtgacttgggtaatcttggcaggacacagtgggtgcagaatctttcacatgctcattttgtaggtctctaacttgctgaggtttattgagaaaacttaaaagctaattaggttctatgtcaggtcctaagaaaaaggcttaaaaaatgaagatgaaaagcaaaagttactggataattattttaagagagagatttgcaaattaaagtctctctctttgcatctattaaattagcaaatgttaaagaataagatattaaccagcagtgttggccaggatataaaacaccagcacattggtgcacagctagtggaaatgcaaatccatacaattccaataaaaataaatttgccactgtatttcatagccactgatccagtaatcctcattctcagaacctttcttagagaaattgtaaagagtaagaaaaaaatccacaaaggtgcccactacatattatacataatagtaaaaatgggaacaaactcaatgcccctaaataaggaagctgataagtaaatctattaattcatattttcaacaaatatttataaattgctccatttctgagttctctgctatatcagctcaataaaatatcttgtagtcagtaaaatcatcaataataaaatatgtaacataagaagtgaaatgaaattcataaaaatacacttttgccatgattataatgatgccaaaattaaatatttttatttgcagtgtttgggaacatggacaaatcaaaattgctcatttattaagatggtgaattctagattattttcttctccactacttgttattcattattacattatttgaaatgaagaaaaatcttattaaacatgtaaaaacgccaggcatggttgctcacgcctgtaatcccagcactttcggaggccaaggcgggtggatcatctgaagtcaggagtttgagaccagcctggaagacgtggtgaaaccccgtctctactaaaaatacaaaaattagctgggcatggtggcaggcacctgtaattccagctactcgggaggctgaggcaggagaatcgcttgaacccaggaggcagaggttgcggtgagctgagattgtgccgtcgcactccagcctgggcaacaagagtgaaactctgtctcaaaaaaaaaaaaaaaaaaaaaaaaaagtaaaagtccccactcttgcagtcctgtgtgagccctactctgggactcccactcccgatcgtgactctctgcacatgagtggcagcagcggcctggcctgggtcttgcttgaccatggccacgggagggctcagcctgtggacctgaagccactttcccaggaagcccctgcttgtttctccagattgttctgctgtactttatttttgctctctcaaatacgatttaaaaccccaaagagaacacactggagagtcatttcacaagaagtccatctattcatttcacaagaaatgactctccaaacacgttggagagtcatttcacaagaagtccattctattcctataaaagcagggagatagccattcatccttgggatccctctgggaattctttagaagcagtgaggctcaggcctataactgacaagctctgctccgcacattccagtggatctgggtgcaaaagctgaccaagcggctgcgatttgcaggggtggaaacctggaatgtaacaaaatacaaagcatgggaaaaatgtgtggcattttcagtttaagttggccagctgagctagctgaactaagccctggctaaactcatacgtgggcaagggcagctatcaccaaagataagccctctgagagtgccttagagggtttatagctatagatatggaaaccagtcccacccgaaaagacatttttatttttaacattctggaagcatgccatctgtaatcagtttgctcactctgaatgagctcgaatgattcaatcagtctttaaaattctttactacaggcaatcaagcacaactttgatgccccgaggggttagagtttctattccctgatcatttgctccaagcaccttctgttcaaaaaaaaaaaaaaaagaaaaagaaaaaaagaaagaaagaaaaaagaacaaaaaaaagaaagaaaaaagaaaagaaaagaaaagaaatatgctttttaggtttgagtttgacccttaagatgagtttcaaagtaaactctttttaaagacaatgtccatggacttgggttttttttgtttgtttgtttgtttgttttgctgtatttcaatcactgcacgtgcttgtgttcaatggcctgtaaaatgtcttgtgtactctgaaaggagaaggagttcatattggaatggcaattgtctatttggattctaaaagtatctgggtgcacagtatttatctgttagcctaaacacagtatttatctgttaacctaaacataatctgattgtaatggggaagactaattgaggtttaatcatgagttcattcacaatggagattcggtcacctgtgttttccccatgaacaggaccagaatatcctggtagaagtacacctggttctgctccttttcttttttggtagaattttttttttattgtggctatatatatatatatgttatatattgtgtatacatatacatataataacatttaccattttagtgtataagtcagtggccctcagttgtgtaactatcactactatttctggaaggttttcaccattccaaacagaaattctctatccattaagcgatcactccccatttcccctgccccctagccccttgtaacttctattctgctttttgtctctctctgattttgccctctatgtgggatggtacagtatttgtcctttgtgcgtggcttatttctttcagcatcatgtccttagggtttatccatgtcgtgacatgtatacaaacttcattcctgtttaaggagtattccattgtattaacatgcactttgtctccgcatttatctgttggtggacatttgttttatttccaccttttgactattgtgaataatgctgctatgaacacgggtgcacatctatctgttccagttcctgttttcagttctcttgggtgcatatctaggaatggaattgctgagtaatgtagtcattctatgtttaacttattggggaactgccaagctactttccatagtgactgcatcattttacattcccacatggtaggattattttattcccagatatttgctacccttctgtgaggaattccgtatctctcctttttactctgggcttggctgcctgatgtgcaactggatacgacaaaagctttagacttccccggtccccattgttttcactccttcctctagcctgttccaaacaggagctgctcctgcaggagtgtgaacagtaacagggctgctgaacagccacagccagtgcacgacacaagtgagaatgaacctgtgtcttggaggtgctgcagtcctggtgccattttgtcccgcagcaaaagcagctccacatacctttgattgttcccttggcctctcctcttttcacttgtgcatgattctctatggggtttctgtttcctttctttgccaggtacttttacatgtgctgtttcctttttctagaattagctgtcctccaaaacctgtgactgattattagggggaagcatacaaaactgtcattgttgcagatagaaagtcatcaaagtctagcagtttcctaaggttaacataactaaaaacaacaatggcagcagccaggcattgtgctgggaactgggttccactaacccctcagctcctctcattaagcttggaatgattcctaaccccattacgaagatgaggaaatgcgaggctcaggctcatcaagtcacttagctcattagtggtggatctagactccaaatcaggctcttaattaggaccctctattgttcaacgttttccctcccatgcactcttctcttctctggaggggctgctggagattcctcgtgacagtacttgttacagttcccattacctggaggttatattcatttgtgctcacaatggtgaagaagcttagccaagcatgtggtatgtattattcttaatcccattttgcagatgaagaaattgagactcagctcatgacagtgctaactgcattgcacaaaagttgcctaaatcaccaaaataagcaggtgcggttctagggaggagagctgaggagactgggttgttggctttgtgaacgcagtgctgtggcttgcctacagactaatgacctgtcttttaacaggactatacaaatccagtcagcctcccaatctaaaatgtcacactcaaggttccctctctcatcccatagagttgcaaccaatgctgctgaaaacatcatacctcatgatcaaaggcataagtccttagttcaggaatttcaaatattttagcagataagcagtggtattttggagactattaatcatgaaaccaaacttcctgaccaaatcttatatctggtcaatgtttctagaagccaccaggctgggtttcaagtgaagacttactaatttacaatcgcaaatgcagcatctgctgttcaaatgggtgggttttttttgccagaggacattccatgtatttagtgatataaggtcctagtccactgttagccacttatttattttctacactccttttcatctgttcaacctcagaagaatctgaaacgtccccagcagttgtggaatttgggttattcaagtggtgcccaccaagtgccaagtccattctagctacaggacttaatccccgcacactcccaaattcaaattccacctggcacacttaatgtgtgtgcttatcttgtagtactcacaccgatccatgggagggagagaggttaagtcatggaagcaaaagctctctcagaagagcatgcatcccaacttcaaaagtagaaacagagtgacgctgtaccttttttcctcagaaatgttgaagtttgaacaaaatgaatctttagtatttttaaaattgacctgggccaggcacggtggctcacgcctgtaatcccagcactttgggaggccgaggcaggcaactcacctgagtttgggagttcaagaccagcctggccaacatggtgaaaccccgtctctactaaaaatacaaaaaattagctgggcatggtggcacatgcctgtcatcctagctactcaggaggctgaggcaggggaattacttgaacccaggaggcggaggttgcagtgagccgagatcatgccactgcactccagcctggatgacagggcaagactctgtctcaaaaaaagaaaaaaaaattgacctgtcgtcagaattttaagtcaatttttgatttaatattatgttgatgatcttgtggagaaatgtttaaaatagaaacaatataaaacgccaaaaataataaaaggaaacccacacttcattgatataaatacgttttaaattttaggatacaatcgccaattcctgattcccagtcaaaaagattaagtagatccagatgtcacagatgtgaatccacatgtttacatcacatcttgaaaacaatcattattttaatcctaccaaggtataagttgctgtattagtgagagactagttttgtgtagaatgacagcagtaaagacggcagtgaaacaaatgtccatgagctatcttgaatttgtattgactctccccaaaatcttaatgatttcagctcattgaggaaattttcctagtacatacccttctcctggcataaagttttcctagagagtctgcaatttttaggtaagaaagaatattaataataaaaaaggaactttccactgatctcaagtttgtgttaatatgatgttcagtctaactccaaactcattccccagcaagaccctctttaaaacatgtgtgtctccccatcctcgtcatttggatttttctccattatgggtgccatctgtctgtaacatctgtcatccctttgattgccaatgtgaatttcgatggtctggctggtttctttctctcttgcatatttctgactacctgtttctcttctcacccaaagaggtataactccacaaggacaaaagttatggaaactatattttcaaacctaaaatcacaacatccatagcatgagaagtatgcctgtacttaaacatactatggggcaaaacatttgaactgtctgaagcacctaggatgcctggtcatcagcctgaagaagacggatggtagacatcagatgtctttctagcaccttcttgtccggagcattgtatcttcaagcaattgttacacttgaatgagtgactaagaatttaaaaggcatttatcattggtgagacttttgaactagtgtttaacattcaaattgtgactatatatatatatatatatatatatatatatatatatacacacatataattttttttttttagatagagtctcactctatcaccaggctggagtgcagtggcacaatctcgactcactgtaacctctgcctcccagattccagtgattctcctgcctcagcctcccaagtagctgggattacaggtgcacaccaccacacctagctaatttttgagtttttagtagaaacaagattttgccatgttgggcacgctggtctcgaactactggcctcaagtgatctgcccacctcggcctttcaacaaagtgccgagattacagacttgagccaccatgcctggccaatatttatcttcttaaaagtctatttctataagcacacagatttagccttctctgttggtgtcatcatcttcagtcagtggagactgtgcagaacccctgggattagggactgaaagagccaatgtcagaatagagagtgggacagagtaagatagcccttctctcctgatttgggcctgctcattgaatcccaatctaaagtggaatggaataagactgctgggtcccatttcaataagagtctgcctcctagcgcagagactatttggaagccacagccagaagccacttaactgagcagcaagcgctgccacagtctgcaatcagcagtcaactggcctcacctatgggcatgcgattccacagccaagactccccagggcataatgtccagccccatctctaaagctacaacagtgggtacaaaaagatgttgcaccatgatagaggtcaacccactgttcaatgaggacaaaagcaatttggcaaagctggcaagtgcagataagcgtggctccagagagacaaaagctcagtctgttttgcttctcaatttgagcaattagcgtcctacgcaatacccatcaattcaaaagctaggcaacgtttctggaagaaatacatttctaggaaagtagactatgaaaatgtttttagaattgttttattatgaattctttttttaaacatttcttgataacagtataaaaacctagtcatatcttaatagttatctaattagctaacgttattaaagcaggagttgcatgaaatagaatcagaatttagtatcagaaaaaaaaacacatgagagttgtatcatgacaaatttctccctgaatgtttgaaattgctcccactctttcaggtacacgtatcacagattcaaggaacagaatattctctgaacttgagaaaaagaaaagtgacttttcattgtcctttcccccattcagaagcaataattacacccaggatacaactgatcttcccacagctggcttcctgagtgcgtgattagctacaaaccttcctacctagtgggacgtgggaaaatgaaatagcaggaagatggaggctgtcattttgctccttggggaatgaagtgtgaaacctgtgggaagttgagagtacactcagagcttagttcccatgcccaagaagataagtacgtccctgaatctcctgaagcaaaatccttcattggtgtattataaccaggcctgcgtggcttgggttagaaaagctgtatttgggttcctattactggtgattgaaaaatctaaacctaaacctgctttgcatcatcacgcctgaactacaagttaccgctgagcttaagaacattttttacttcatttacttgtctggaagcaaaatggttctgaagctgttttggaaatatacaagtatatctatctccataatttatctatctatctatctatctatctatctatctatctatctatctatctcttagtattcaaaatctcaaccaaacagaaaatgcatttgtgacttgaagcagacggagacacccccagccccacccacctactgatgttgcttcattgggaagacaggcaatgcaggaggagttccaaattaccactctgggttgaaagggtctcaaagtcaggcacacaaatacaaaataaaacatctttgcaagttattgtctgttcagagtgcacagctaggagaaatggaaaacaggcattcagtcctctactcctcctcctcctccatctgtcttcccctttatcagttgattggccatgtcaccatggcatctaggctctctgcaggatgaagtaggagaatatgcttataaggatggagaaggcctgcttgtccttgcttcctttgtgatctgaggagaaagaatggctccactgcctgcaactccaacagacagaacagaaataatatccaggtagacaagaaatgaacagtcagcccgttaaggtcaggaaaaaccatcaaagacaaggcgtcagatattcatggaccatacagcattcatgtgtccttctgacatcacgagttcaaacaagtgcttttctttttcatcaaacttttaattttgaaataattgtagatttgaatgcatttgtaagaaggaatacagaaagaccctgaaccatttactcagttttcccaatggtaacaacttgcacgatgatagtacaatatcactaccaggatattgaaattgatgtaatccatcaacatatgttgtgctttcaaaatcagtttaactgcttgaaaaagtagcatatccacagaaatacctcaggctggataaacaggcctgaaggggacatgttgtatatttatgaacaggctgctttgtctggctgagggaagtgtggcaggcatgggtaaatcattgaatcatgggttctttgaactgatccaacttctctctcactgacagcacttactgtggaggaggaacttttttgcattttgtttcaatttaggatttcctaaaattaagatgagagagtgtccagaagggtatataccaatcacaaggatgaagaacagaaagatgaaccttctgatgtgaaactttagagaagagagaaaaacttttatcatgcagtgggagaagtagaggatcaggaaggacaggatagacagcaacgcgctgatgggtgcacccctgccaggaaccctgctgccggccactgtgtttctcatttgccgggtgtgcctccccagagagaaaatcaagagcaaaacagcaaaaaggaagataagcaatggcactgagaactcagcaacaaaagagaaaatctgtatagccagtgtatcttctttttgaattgtggcattttgggagaaaaatttccttaggaagtatgggaccataaaccctgcatatttgctatggaaaacacaaatcatagatacatatagcagagaccccaggatcatccatgggaccagcttggatatcctcatcttcaaccagatgaagagtgggtgacggacgctggcaaccttggcacaatagaaaacgccgagccatgtggcaagccaaagttccaattcatttataaataagagaattgcacaattcgcagaacacatgatgaattctatgaagaagataacaatcacattaacgtagaagatgaacaactgcagaaaaattctagaaactgccagacaagaaagaaggagatccagcggagccatttttctgtgcttgatcaagtcaatgccattcaccaccacaatgatgccatttgtgaaaatcccaagaagaaattgtatcactgcaagaagaaaatagataatgaggtgagactctagcattttaggaataaaaaattatttacttaaaaaataatgaagttataaagttttggacaggttgggttgttcacgctcttcaattagatcaggactcctctggggaagaagactaacaataaaggcatggggcaggaaggtggtgtacatttgtttatgtcactgctttctctatttagttctgagacagtcaaataaggaggagatactctagcatcaatttgcttcttattgatggcttttgcattttacaggtttacctagctttcaaagtcatcacaggcaaataatggaatcagacaccttcagacagctgggagaacagctcctccatagtaattagccaaagatactcaattcttcatctctactatgaataattgattttgcctacaggtgtgattctacttaatgttatcgtgtactctttaaaaatatacatttttgaaattttcacttatgttatgatgatatggtacaaccagcaacataggactcctgagtagttctccaatatgcaatggttgagcaattcaaaactatctgtaaaatagttatagaataaaatatacataataaaagtatctctaagtataaaatcaaagtaattaggcttgcacatacatgtgtacaccaggtcaaaggcctaaagaaaagtaaggtgtaatgaaatgaagacaagcactcagcactgttcaccctggtcagcatctgcagagtaattcaggggttaaaatcttttctctcttatttttccaaaattatgagagttttatgacatgagctagttgttctagtagaaaagtaaagataaaataatacatgattaaatttgttgctttcagtctgtaatgcactatgaaaaattaagttggtatttcttaatatgtataccgtgctgcctgtaatgctgaagtgggttttctcagtctttacattattgacattttgggctacataactctttgttaggcacgggctgtcctgtgcaatctaggaaatgcagaatgtctaccacatgcctgtcctctacccaccagataccctccccaggctgtaacagccaaaatgtttcgagacattgccaaatgttcaagagtggcagaaccactatgacgggacaaaggtagataaagtatagtttgtaccttccagttatcccaagactaaaggcagaatgagccacatatataatgtgatataaaactaagtcctctctctctctttagagacagagtcttgctttgtcacctaagttgcagtgcagtggtataatcacagctcactgcagcttcaaattcctggactcaggtaatcctcctgcctcagccttctgagtagctaggactatagatatgcaccaccatgcctgactgctttttaaaaatttttcatagatatggagtcttgctacatagcccaggctagccttaacctcccgacctcaagcaattctcctgcctcagcctcttgaggtattaggattataggcatgagccaccactcccagccaagttagttctttagacaattcatcaccagagcacaaagtggggaccaattcaataaacactgggggaattaaagcttctccaacttagcacttaatcaaaaggtacctggcagacctgataatgaagcatatgtcttaatgaacgtgtgttactttgtctaaatgtgtcataaagaatacttaagattaatcttatttttagaaaactggaagggaagtcatattttaaaaaattagtcgtgagagtaaatctgtaggttcttttatggctcttctctgaataggaccatctatgccatcttggactcactctgttcttcctgacacaactacagtgagatgaaggaaagagacaggatcatcttcaaggaagcaccaagggaggtgttcatgagcagatgccatcagaatggatccaaatgcaagcatgccaggaggatgagccttgttttccctccagtagaaagaagaagaaactttgcaacttagaagaaacattctgcagcttagaaaaacagaaatgtaagggcatgcagctatgaaatacaagcatacttccataatactgtgcattaaattctagaccaccaaaatacaagaatattgcaataaggccagtcacactaatttgttggttttccagtacatataaaagttatgttgatactaaactgtggtctattaagtgtgcaatagcactatgtcttaaaaaaagatatacatactttaattgaaaatactttattaccaaaaaatgctaatgatcatctgagctttcaatgagtcataatctttttgttggtgtagggtcttgcttcaatgttgatggctgctgactgatcaggctggtggttgatgaaggttgggtggctgtggcaatttcttaaaataagacagcaatcaattttgtgcattgatgaactcttcctttcacaaaagacctctctgtagcatgtgatgctgtctgacagcattttacccccagtagaactttcaaaactggagtcagtcctctcaaaccgtgccactactttattaactaagtttatgaaatgttctgaatcctttgttgtcatttcaacaatgttcacaacttctttaccaggagtagtttccatctgaagaaattatttgctcatctgtaagaagcacttcctcatttcttaaaaacatcatcataagatgacagcaattcagtctcatcttcaggctctacttctaattataattctcattctatttccaccacatctccggctatttcctccactgaggtcttgaacccctccaagtcatcaggaggtttggagtcaaattcttttacactcctgttattgttggtgttttttttttaacctccttccatgaatcacttcttagtggtatctaaaatggtgaatcctttccagaaagttttcaatttactttgctcaggtacatcagagaaatcactgtctatggcagctgtagccttatgaaaagtattttataaataatgagacttggatgtcaaaattacttcttgatccatgtgttgtaaaatgaatgttgtattggcgggcatgaaaacagcatagatttccttgtacatttccatcaaagctcttaggtaactactcttaggtaactagatgcattgtcaatgagcagtactattttttaaaaacgatttttttctgagcaataggtctcattcattttttatggctgagtagtattccatagtgtgtgtgtgtgtgtgtgtgtgtatattatatatatatatatatatatatatacacaaatgttctttatccactcattcatcgatgggcatttagactggttccatatttttgtaattgcaaattgtgctgctataaacatgcatgtgcaagtgtctttttcatataatgacttcttttcctctgggtagatacccgggagtgggattgctggatcaaatggtagttctacttttagttctttaaataaactccatattgtttttcacagtggttgtactagtttacattcccaccagcagtgtaaatgtgttccctttataccacatccacaccaacatctattattttttgatgttttaattgtggccattcttgcaggagtaaagtggtatctcatagtggttttaatttgtgtttccctgataattagtgatgttgagcatttttttcatatgttgttggctatttgtatatcttgagacttgtctattcatgtcctttgcccatgttttgatgggattattggtttttttttcttgctgatttgtctgagttccttgtagattctggatattagttctttgtcagatgcataatttgtgaatattttctcctattctgtgggtcatctgtttactctgctgatttatttactgtgcagaaactttttagtttaattaggtcccatctatttatttttggttttgctgcatttgcttttgggttcttggtcatgaactctttgcctgagccaatgtcaagaagagtttttctgatgttatcttctggaacttttatggttttaggtgttatatttaggtctttaatccatcttgaggttgtttttataaggtgaaagatgaggatccagtttcattcttctacatgtggcttgccaattatctcagcagtatttgttgaatatggtgtccttttcccactttgtgtttttgtttgctttgtcaaagatcagttggctataagtatttggctttatttctgggtttgcttttttgttccattggtctatgtgcctgtttttataccaataccatgctgttttggtaactatagctttttagcatagtttgaagtcaggttatgtgatgcttccaggttttttattgttgttgttgttgcgtagtcttgctttggctatgtggtctcttttttggttccatatgaattttagtttttttctagttctgtgaagaatgatggtggtattttgatgggaattgcattgaatttgtagattgcttttggcagtgtggtcattttcataatattgattctacccatccatgagcatgggatgtgtttccatttgtttgtgtgatagatgatttctttcagcagtgttttgtgttttaccttgtagagatctttcacctccttggttaggtatattcctaagtattttgggtttttgcagctgttgtaaaagggactgagttcttgatttgtttctcagcttgcccattattggtgcatagcagtcctactgatttgtgtacactgactttgtatcctgaaactttactgaattcatttatctgatctaggagcttttttgatatgtctttagggttttctaggcatacaatcatattactggtgaacaacaacagtttgacttcctctttactgatttggatgccctttatttctttctcttgtttgattgatttggctaggacttccagtactatgttgaatgaaagtggtgaaagtggacatccttgtcttgttctagttctcagggagaatgctttcaactttttctcattcaatataatgttggctgtgggtttgtcctagatggcttttattatcttgaggtatgtcccttctatgccagtgttgctaagggttttaatcataaagggatgctggattttgtcaaatgtttttcctgcatctattgagatgatcatatgatttttgtttttaattctgtttacgtcatgtatcacatgtattgacttgtatatgttaaaccattcatgcatccctagcataaaacccacttgatcatggtggattatgtttttgatatgctgttgaatttggttggctagtattttgttggggacttttgcatctactttcatcagggatattggtctgtagtttgctttttttgttatgtcctttcctggttttgacattagggtgatactggcttcacagaatgacataaggaggattccctctttctctatcttttggaatagttttagttaagattggtaccaattcttctttgaatgtctgatagaattcagctgtgaacacttttggttctggacatttttgttgtgattttttttttttactactgtttcaatcttgccacttgttatttgtctgttcagtttctatttcttcctgacttaagctggagaattgtatattttatccatttcctctagattgtttagtttatgtgtgtaaaggtgtttatagttgccttgaataattttttgtatttctatggtatcggttgtaatatttcctgtttcatttctaattgagactattggatcttctctcattttttcttggttaatctcactaatggtctatcaattttgtttatcctttcaaagaaccagctttttgtttcatttatcttttttgttgtttttgtttcaatttcatttaattctgctctgatatttgttatttcttttttttctgccaggtttggggtttgtttgttcttgtttctctagttccttgaggtatgaccttagattatttatttatgctctttcagactttctgatgtaggtatttaatactaagaactttctcataacactgcttttgctgcatcccagaggttttaataagttgtctcactattaccgttcagctcaaataattttttttaatttgcatctcgatttcattgttgacccaaagattattcaagagcagattatttatttccatgtatttgtatagttttgagagttccttatggagttaatttccagttttatttcactgtagtccgagagtgtacttgatataattttgattttcttaaattatattgagacttgttttgtgacccatcatatggtctatattggagaatgttccatgtactgaagaaaataatgcatattctgctgttgtttggtagaatgttctgtaaatatctattaagtccatttgttctagggtatagtttaagtccattttttctttgttgactttctgtcttgataagctgtctagtgctattagtggagtattggagtccctcatctatctcatttcttaggtcttgtagtaattgttgtataaatttgggagctccagtgttaggtgcatatatatttaggattatgatattttcctgttagactatccatttattttatcattatataatgtccctttttgtctcttttttactgttattgctttaaagtctgttttgcctgatataagaatagctactcctgcttgcttttggcgtccatttgcatgggatatctttttccacccctttaccttaagtgagttcttacgggctgggtgagtctcttgaagatagcagatacttaagtggtggatttttatccattctgccattctgggtcttttaagtgaagcatttaggccatttacattcaatgatagtattgagatgtgaggtactttctattcattgtgctagttgttgccttaataccttgtttttttttttccattgtgttattattttataggccctgtgagatttatgctttaaggagattccattttggtgtatttcaaggttttgtttcaggatttagaactcctttaagcactttttgtagtgctggcttactagtggcaaattctcttagcatttatttgtctgaaaaagactttatctgtccttcatttatgaagcttagttttgctgggtacaaaattcctggctgacaattattttgtttcaggaggctaaaaatggaaccccaagcctttctggcttgtaaggtttttgctgagaagtctgctgttaatctgataggttctcctttaagggttatctgatgcttttgtttcacagctcttaagattctttcctttgtcttgactttagataacttggtgactatgtgcctaggtgatgatctttttgtgattaatttcccaggttttctttgagcttcctgtatttgcatgtctagatatctaggaatgccagggaagctttgctcaattatttcctcaaacaattttccaaactttcagatatctcttcttcctcagaaacaccaattattcttaggtttggccttttaacataatcccaaatttcttggaagctttgttcattttttaaaattcttttttctttgcctttttctgattgaattaattcaaaaacatagtcttcaagctctgaatttctttcttctacttgttctgttctatatttaaaattttccagtgcattttgtatttctctaagtgtatcttttatttccagaatttgttagtgttttaatgatacatatttattttgataatttttcatccatatcctacatttttaaaatttctttaagtttgtcttcacctttctctggtatcttcttaagcagttgaataatcaatcttctgaattctttatctggcttttcagagagttcttcttggtttggatccattgctggggagccggtgtgtgtgatgttttggggtattacagaaacctgcttgtcatcttaccagaattgcttttcttgttccttatttgggtagactatttcagtggagaggtctaaaactcaaggcctgctgttaagattctcttgtcccatggggtgatccctcaatgtggtgctctctttctttccctagggatggggcttcctgacagctggactgactgcagtgattgttgttgctcttctgggtttagccacccagcaaggctaccaagctctgggctgatatcaggggatgtctgcaaagagtcctgtgatgtgatctgtcttcaggtctcccagacatggattccagcacctgctctagtggaggtggcagggaagtgaagtagactctgtgagagcccttgattgtagataggtttagttttctggctttcttgaatgctggttatactagcagtgaagttgtcatgtggacagactcagggcctctgcttagccaggatattgcaggcagtggaattaggtgttgtcttctccttcctggggtcagggttattctgtcctgagttgctttaatgacctgagttggttgtcctccagccgggagatggcactttcaagagagcaccagctgcagtagtagcagggggctgtaagcttgccctaagatggccagggtaattattttggtttctcatgtgatgtgtggggccataaagctcccaagaatttctatgtcttgagtttggctaccagggaaggtagggaaataccatcaggtggagtcagggttaggtgggtgtgggctcagactctccttgagtggggcttgccacagccactgtgggggatggaggtggtggttctcaggccaatggggatatattccagagagaatcttggctacctctgctgtatcatatagttcaccagggaagtgggggatagccagtagcaagaggcctgacccagctcccacacagttggtgaggctggtctcactccagcagtgcccccgctcagtgcccaagaccatgcgcaccccactgggaaagcaagcatggctttcagacctagcccctctccactgcccgctccattggcagcagctcctgtgcttgcttgcttatgcctgcagcagctcccactcacaccccagactctgctcaagaaaatttgtgcccagtcaaaaccattaccaatttctgatgggaacttccttcaccctgtgacccctccgcagttgtattggctggcttccccaagggaccctgtgagatatactcaatgatggcttccctgggctcaagctggagactgggagtgcatgcaaggtactacccgctgctacttctacttttatatttggcacaactccctaaaaccattttatccctaggtaggttaaatccttctcctgtgatctggattttcagattccccagtgggtatgtgtgttcaaaggtaggttttcctcctatcatgctttgggaactcacagttttttgcctgttttgtggaatttgcagcagcacgccactctttcaaaggatctgtgaattattttggttttcctggcatgttcctgcagtggttcttggagcaaaagatcatgatgtgagtctccacacactgttctgccatccatgtggaagatgcacattaggccgttctctgccatcttcccccgatctccaaccttagctaaatcttctgaattgctgcagcttctacataagcacttgctgctttaccttgtacttttatgttagatggcttctttccttaaacgtcatgatctatcctctgctaacttcaaacttttcttctgcagcttcttcacctctctcagtctcatacaattgatgagagttagagccttgctctagattaggctttggcttaaggaaatgttgtggctggtttgattttgtatgagagccctaaaattttcttcatgtcagcaataaggctattttattttcttacacttgagtgttcactggggtagcacttttaattttcttcaaacagttttcctttgcattcacaacctaagcatttggcctatcatggctctcaacatgcctttctcactaagattaaccatttctagcttttaatttaaaataagagacaggcaactcttcctttcacttgaacactcaaaggccattttagtattattaattggcctcattttaatattgttgcaagtcagggaatagggaggctcaaggagaaggagtgcaatgggacagccgggtagagggtcagtcagaacacacacaacatttatcaatcaagtttgccatcttgtttggacacagttggtggtgtccccaaacaattacaataggaacatcaaagatcattgatcacagatcaccataatgatacaaaaataataaaaaaagctttcagatagtgaacgaattaccaaggtatgacagagacatgaagagagcacaagctgttggaaaaatgaccccgataaacttgcttgacacagaattgccacaaaccttcaattccttaaaaaaaaaaaaaaaaaaaaaaaaacagtacctgtaaagcacaacaaagtgaagtgcaataaaataaaatgaggtatgcttgtagggaagccaagaactctcagaaaagcagttactgctagttccttggtttctcagtcaagcgtctatcactgcacctgtcctttctattgcaaatcttggttaacccacctgcgccctgcaacactcagctctgagaagcagatttgtgctttcttctcatcctcagtactcttcattcattaattcacttggtgtttaacataaggtgggtgtgttaagtaaaaccagactcaattatgtaagggaggaaaagaaaaataaatattaccagaggaaaaaaataaatattagcaagccacttagaaagacagtcattgttttctagctctctcttcctggagaacccagaccatgacaccagcatggagttcatccctgtttgctgtcatattgccatgacatttctgtactgatcccgtggtgtgcgccttcagcaaggtcctggcatttcagtattgcaagaaaagtaacaagaacactaaagtgggaaagtgaaaaaaaaaagttcacatcctgagtctaggatagcaatacagtttttcggccctgacaggaaactagcagagataatacatattgcaccaaagacttaaaagaaataacgatgtccaattctatttattagcatgctatttgtctttcggattctaggatcctgaggggccatttggttctcagatattctattacaacttttgttttaactagcttggggagcagagacaattcttcatagagaactttattttgtgtagaataggtcttttgatatgggaatcccatggagtgaaaagtaaaaattcataaggcttgtgctacatttttttcattacataatttctgtcactgtctcttccatgggcacacacagagtctgccaaagattcaccgttcctcactctcttgagactcactcttcttaccctggaggatggaaaaataagagacgtctgtctgtaggtgtgcagcattcatgtgactgctaaactaatgtccccttttgcttcctgaatgagcctcctttcagtgctggggtgaagacccccaaggacatgttctccagccttcctctgaatctactgcatcaatcaagccacagatgttggtcatgctcttgcactaagcaagagtgaactaaatattttaacactcaacacaacaaatacaatttttaaaacaatggcactgagtataaaatccttttaggtctttaaacagtttgttttagtgagaagggcacatcagagaatttctggctctcagatgaaaaacgtatatgtctggcctcacctgtcagtcagtggcttggaacgttgacagttttacatggacaaatagcttggaacagatgggacaagacctgatgtggagaaattcacatgattattaccctgtattaccctgattaaatccattcacttgcactcatcttaatgagcaatcattaaaggagacagcactaaatattcttgaggtaactgacaggcggaaagagttgcttatttatattcaaatcatttagctcctcaaaagaaagtgcgatttttttcacatgcagttagattgacgttggaaagcttttcatcaggtagaaggctgtaatgttcatctttctgctttccggcggcacttggacatttgctttggtattagaggcatcatgaaagtgagtggtggttttaatacctttcccaagtgggccctcacacttcattatcaagggaacaattcctgctttaagaaacatgtgcatgtattaacattgttgtatatttaataagatcattcaaataaggaagaaatagactctgagcaaaccaacccagacatcctttctgaatcttcccgatagcagagctcggcccttgtaaagcctatttggaatttatttcatttaaaattcacaacgtcttggttaaaaagcaccagattctttcaggctaatcattcttcagatccattcatttgcttctctccacttgaatttgcagttgatcttttagactaaaatttttgtctttaatattcaggtcactttcatatacttgtcccttcccttgctcaatttattctagtaatatatttctgtgctttttcttactccactcaatattctgagatgtatttgcaatgcagcaaatagaataatggagcaatgcaatacattgaatttaagtcttccacataaagaactcaaagtgctttacaaacaagaatcccttgttagttacaatgaggaaacagaagccacagatgctgcagttgaatcatgggaatagtctctagtcctcacgattttgtcttcagctctaaactgagttcctccgtggaatttcaaatccttccttgcttcttccctccctccttctctctttctttcccttctttcctttttccttctttcctccctccttctttcctttctttcctttttccttcttccctcccttcctctttatccttcctctcttcctccttccctcccataccccagcacacacttattgtttgtattatgaactaggcactgttctaagcacacagcatttacagccatgcactgcttaatcacagggataggggatacactgtaagaaagtaatcgatagacaattccatcactgtgcaaacatcatagagtgcacttacacaaacctagatggtatagcctactacacacttaggctgtatggtatagtccattattttgctcctaggctacaaatctgtacaacatgttactgtcctgaatgctgtaggcagttataacacagtggtaattatttattatttgtgtagctaaacatagaaaaagtacagtaaaaatagggtacaaaagttgaaaaatgtcatatgtgtgtagggcaattaccatgaatggagcttgcaggaccggaagttgctctgggtaagtcagtgagtgagaggtgagtgaatgtgaaggcgtaggacattaccctactatacactttataaacattatacacttaggctactctaaattcataaaaaataaagtaattgtgctaggacaatacaatggctttgatgtcactagctgataggaatttttcaactccattaaaatctcatggaaccaccattgtatatgcagtccactgttgatgtaaatgttgttatatggtgcacgactgtagtaatgaacaagacaaagcttctgtcatcttggaaatcacactgtagtggggaagaggagagttaaacaagtgaagaaataaataattccaggtaaagtagaaagaggtgctattttagaaagtgtggtcaggaaagcctgacctccccagagaggaggtgataaaagacctggatggaagatctgggaatgaacacttcaggcagagagaggaggaaatagtatcctcactccccatcccatcaataaaagagcttgcagcattccaggaataaacaatgcccagcaaccctgcaatgtgtggggcagtatgaataaggcagagcagagaggaagttagaggggaaggcatggagactgcatctcaccctcaactgaatgggaacccattgaagtgtttgggtgagggggaagctttgttataatcacatttatatcctacaacatttactctgactgctgttatttaaagaaaggcatttactctggagaacatatgtggaggttgggagaaggcaagtgtggaagtagaaataacaactaaaggctgttgcagtagaccaggcaaggcatgttgttagcttaaattaggttggtggtcaagatgggaagaagtggctggacgaggaatagattttgatggcaacaccaacaggaaattcagttggctttgatggggagtgagggaaagagaggaatcaagaaatactcttgggtcattggcattatcccctggtgagcaatggagccatttttcaagaaggagaaggttgaaggaaggttaaaatcaagagctctgtgtggacatgctcctgagacggctactgcaggtagagatgatattatgtcatggatggtaagtttggagtttgtgggaactatcaagtttggaaatatgcatttggaatttgctagcatatagaggatattgaaagccatgaggttggttaagattatgtagggatgagattgccagctggagtatctgagcactgtaaataagaaaccacattttgtgcattcgtgtcacttcgattgtcctgtctgatgccatctctttgtggaaggatgccctgacgagagcagagtaggtgagtcagagcttgcattactgaaagcaattgtggaactagtactagtcatggtttcctaatctctttatgtatggctgattttatttgctgtttcatttagaatttttcctccttctaaggaagattggtctgcagatttttattggtgctatatttaataaatttgattatctatgttatgctggatttatcaaaagattgttaagcttttcttatttctatgcaccagaacaaattaaataacatgggaattatctgtttatttgttggatggaaagaattcacagtgagaaattctggtgccagaggcatttgggaagaggcagaatacttaccaatcatttagtgcttacaacgctaaacaattgaaaggcataacatcaatttgtcctcttgacaattttatgaaatcagtattctttccactttagagattattaagttgaggtgcactgaggtctggaaattgccctcagtcatgcagctaaaaagcagcatttccaagttgtggaccacaatctgatttcaaatgctatgcgtgcatttagccattaagcatcaccgcgtcctatgttaatacccacagtgagagtgaagattcctttcagtggttcaggcataaaatttggacagctgccatttactgcccatctggcatttgtccccttgcctttaccctgactttctttccaggaaccactctcctccacccttgtttatgggccttacttggggctgactccatcactgaatccaggagtagtcacagaaacccaggtgtggcagtcaacatatccattcacctgagcaaaagagatatatccagggataaacatgagacccaaattcatcaagtcagaactaatcccaaaacttctcactgggcaggctctctgcagacaggatggttgcctggcatatccatcttgccaccatgagagaaggacttcagcctgcccaagaatggattccatccagaggacaaaagtgcccagaaaagagaaagcaagaccatgttctcctcagaatatgtcagcctcagaaccagccctcacttactgctggccttgacatttaaatgaacccacaaattctcagttgttactgaagtgggcttgagacggttttttgtcacattgggtgtgctgaaatagttgtggactattatagaaaggtaatgatgtattttctatttctcatagttagtaactggaaccagacaaattatctgcctaaagccagtcatttagtgaagtaactagggcccatacctgtgacttgtatattagagttttgagtattctattcactagatcatacagttttctcaaacatatctgtggaagttacttagaaaaaataaaatacaaatttcttttctggattctttccctatacatttagttattcattttccatcacttagttactctgacggctcagattttattgtgctatagaagagttctcaaagcataaggttaccatatgggcatcagaagttttattcattccaaaccgaacagaatgtctttggcattgactggctatactttgttcaaaagatgcatggtcaaatatattttcatatgaatttgcatatatgtggctgcacaaccattggattggacacatggaagatgataatgtgtgctcttgaaacaagcagtgccatttctgccctggtccaaactcaaatggttctcttttgtcgtaggagtcaaatttatttttcctgcccttcaaagatacaatacttccttacaaattacctcgcaaggatagaactgggtatttcagattttcatatatagaagctgccctgggtcttgctgctgcctctccccttcaaagcagctgtctccagatacaggattgccagcttccagaagaccaaaattgttgtgccttgctttgattttccagaatgtgggaccagcctttgtggttacttagttcatgtgttttggggaaactgaagctatctcttgcacccaggaatagacataaatgtgtgggtaaagatagggatgctctagaaacagctgctgaactaacaatgaaaacaaatgaatacaatttctcatctttaggaagtcattgctagccaaactattactatgcaaactatgtaatatttgtcatagcgtataaaatattattccatctacccatatttgtggacatttgtagcaaataagtggggtaaaggatagggactgtgacaatgatatggcatgaatctcactgactcagaggaaatgaaaaaccatgaactcggctttttaaattcaatacagtaaacttaatacagaaccacatcaaatcagatctgtaaaggatattaatgattatttgtgccaactccttaccatatgtgaaaagagaaaatagaatcccaacaaagatgcataagaccctgtaccttgacccaaggactattcagatgtcttgcattctagaaaaaagaatattgtggatttatttgctttagttttgaccagcacagcctccacagaagcatagtccaactcagtgggtggatgttatccacagtggcagctgttatcaccccaaggcaaggctagtgaccatgcttttgaggagagctgtgcaaaccccacatacatacatttgaatctcaccacagttgactgaaaaacctagatataggagtctgcacctcctcctcaaaatgtgagaaaagtaaaaaacatttagcaatggtactcaaggtcctccagccacgtgaatagagcaaaattggtccaatatattttaaattacaatagtagtatattagaaagggaaatataagggaaacttttagttataattttctgtagacattaatatttattcttgtatacatcagactttctacagatagacgccatgataatatagaagattcattttatgaaatattctttctcaattattcacaaatctgaatgttgtcttgttatcgttaagtacataatatgaatttattatctattctccctgcctggcatgaaacatcatttagataatcatagattctactgaagaggaagaaatttgaataatgttaacaagcaattcatggtggggcttttagtcaactttatttttctagttcgacttaacatagtgattcacaaagcttacttcctcctaagaattcacataaccatgaaaaaagtacttttggccataaaacaggatgagatcaaatgtatctcaaaagcaactattgtcagctatattcaaaatgcatcattctttgatctaaaatggagaaagtaagtgtggccatggctacacagcagtatggattggggagagaatacttcaacatgcaagagaaaaatgtgatcttaattatagggacttgtaattaatgcatttcaggcctcaacatttaagttgcattttggtaacttttaagtaaataaaaattttaaatgaataaataaagcttttaaatagtttttaaataaataacttaaaactaagaaatctgtttttatgccttttttccaatctatcaaattgacaatataacagatctgcattgttcctgcatcatttcaggtggcctgaaatttgacaagaagaggacatatgaatgtcttctgtaaggttagatgaagatcccaatgcactgagtcaaggtctctgaatcgtggggaacatgaggtagttaccccaagcagaagcagaggccacatccctcagctcggtgtccagtggccccacattcattcatactgggagatagcagcaaggaatgatactttctttgcaatacatggtactgtcgaaatgaaaaactcaataatcccttacaggatctccatcatttttttcgggggtggggggtagctagggacgtatagactctatactaacaatcttggcccttaactagaaatatcatggccgaccagtgaccttttggatacatatggacctcaagccaaatacagccacagcaaggccacaggctcatgaagaggaagaaggcagggtcggtgcccaggcatccttcgagaagctctgtctccaacttttctcatctggaaagcccctcttccttttgctcattgcaaaatctgacttaacactcttttatctggcagtgcttaaagtgagtttgacctgaggtccacaattgctaattgttgaaagagaactagaaacacttgcttaattccgagggtcaacatcaaaaacaaacctgaccaaagttgcagaggaggtattttacaactaacaacaaccttaacctgacttcgtttatcaaatgtcctcagaattatgatacacccagatctttggcattgtatttttttgtccaccgaacaaaaccgggaagctaccaaaagtcatgcatggaattcatgtgtaccactagcagtgtgtgagatcagcagaatgtttctgaaagctaagagctgtattcaaagaactgatcacaattgcatttgaaataagttatctgccactatttcttttggccataatgtggcaaatgttatatagacaagaaaatatttagtaaaagttggaagtatttgcaaaatatttgtgcagaagtttgcatctttaattgtatgacctcattgtagttgcacagggagactccagctacatcttatcttttcaaaatactcctgagcaatggctttcctacaacctctttggaatgtagcattatcagcttctatttccccaatttcctataattcaataaaaagtcagcaataacatgtccaagggcatgttatctcaaatgtggattttaatgaaacacaaatatgcccatgcatgttttagcaaattgttctggaccatgcaaaaatgcattaaaagtggaggcatatttacatttgttttgcatttgttatttaagaggtcagactatgcaaagtgcatccacttttgtcaatagcttcaaggagaagaaaattttattaaagttagattcatgacaaacagatgagttaatatctgtcatttgggggaaaaggttttgagaggctacatttttaaaataataggcatttattacttttccaaaactgagaatacttaacaaatgtgcctgtctattttaaaccaggtatactggtctgcaggtaaatttccaattaaaaagccaacttaattataagcagtttacagcacaaagggagattgttatatagtctggaattggccctggaaattttaatataaaaaataaaattagtagtagaagaataaaagacatttagtgatttccaaaaacttttagagacaattcttgctcaagatttacaaataaagaatacaatagaaaaatttgtattctaagatgatagaaaacaatatattctaacgttgcttaagagatataatcttacgtacttgctggatttgtttgtggttgcctttgccaaaggaaacttttttcaaaattaaagaattttttttttcctaaaccagcctctgcatttgcccctgaatgctggggaaaaaagggtgtgcaggaggggtgggcacaataaaaactgtgtgtgtgtgtggtgcattttctatacactcccggctatgtaggacggacagacccatttctacagtgttacctggattctctatgtagctacagacctactacattggggattacacaactctatgcctctaatattatgttgggctttgttggacacagcacaccaaggccagggtggacctggtggtgtgcacatatgctgtccgtgaagtctgaagtctaacatacttagaacattccttcttccagaatcacatggattcatgacctctcctaattcatctctatttaaatttcacttcatcacaaaagacttggtccgattatcacaccccacatcaccagcattctcctcatccctttccactgctctgttctccttatttggttagtacttactactatccaacatattttctgtccctcttcctagaatataaagttccattagaacataaactatttttcttcgctgctatatacccagtaactagatggtgcttggcacatggtgggtgctcacaaatttttatggaatgaatgtataattaaatgtttaaaataaaaatacaactgctgatcaatgacactgcagaaaggtccaccagagaatgcaacctgaagattggcagggaagtaattcatgaaatggctattgttctgaacacttagaaagtattaagatttcttctacctgcttctgacagactcagagtataaaaagtttcaaaagactgtgctgtggtgtggagaaattccaaatggaaaaattgaacatattctgtcatcagctcctttcagacagatgctctcaaggtgatcgatttggcagtcctggggagggatgatattacgtttcacatatacatcactggattaatcctcattgtggtattaaatctaattaacataaatctgtgcagtgacttatgttttaaatgatggggtaattatttaaatactttctactatgaagggagttgcgggcttgggttggagagacatagccaaaccagaaataggcaacaaaagactttccagaagaaaaatgtgacatagtccaataatatgagtgttacttaagaacacctaatacgctaaatactgatctgacaaagaagataaattgagaaatgatgattcatattcccaaagatttttttcatgttaatataagcatatttaatggagaaatccataacagattttaaagctttcattttctaaaagagtacgactcaaatttttataaacatatgtatgatatcaatagaggtaaatccatctcatttgagtgagtgcagctccagctttgtgtagatcttgagcatccttggtgagggtatgagaatgaagaacactccggagaccagaagcaacttatgactcaccaaagctctgactgccactcagtagcgttctaagccctccattcattcccattccacttcagtgccaagcatctgagatgggaaagtcatcttcagcccaccaacaagccctgagcggctgggcgtccatctccccatctgtaccagtggcacacatcactgttccattcatcatgtctatgaacttgatctgatttttgtcatgactgtcactataaaagtcactctgcatgagtgtcagaaggaaatttagaggtctgttgctgaggtaatatattttcagatcaaaatgtgggttattgaaatcattatatgtatattcacatgactacatattatcatgttaggagatgggactgatcatggagacatagtatctctctgcatcccatgagacatatctttcttacacaattcccactgctaggaagatcactgaactttccagaaagacgttcaccaaatacgctcttagtgggacccaactacacatcgtctgtggcagagacctacagttctcatgagtatctgagcagctctttttcctggaaacacagctgaacacttcccaggatcccttggattatgtgtgtctctgtgacaaagtccagccaatggaacatgcctagaatcaatgtgggctactccggggctgggcccataaacactacccagttactatcgtcatcctcttcctcttcactggctgagtagagaggattccaaggagctatagggagggggagccacaagacggaaggatgtggcttcctgaataatgggatggagatttaccatggctgcctgcccccaccacacacacaatggacagaaataagagagaaaagtaagcttttattgtattaatccattcaaattcagggcttgtttgttttatgattaacataccctgacaaataaaatgaactttaatggtttttcagaatctgttgcatttcattttctaaaagattacaatgcaaatttttataaacatatgtatggtatcaacagaggtaatccttatctcatttgagtgagtgcaaatgagatatgcatttttcttctgttgcatttacttttctaaaaaatattattttaattgtggtaaaatacacatatcataaaaattgccattttaatcacattaagtgaacaattcagtggcattgggtacattcacattttagtgtgtgttaccatcagccacctccaggatgtttttcactttggaatctgaagctctatacccatcaaacaataactcaccatttcctactccccaccccaactgctagcatccacctttctgcttcctgtctctatgatttgactactctatatacgttttccgagtggaattatatagtattttgccttctgtgactagcttatttcacttggcatgttgtccttcagaatcacccaagttgtaacatacgtcagaatgtccttcctttttatcacccacgttgtaacatacgtcagaatgtccttcctttttatcacccacgttgtagcatacgtcagaattcccttcctttttatcaccaatgttgtagcatatgtcagaatttccttcctttttaaggctcaataatgttccattttatgtatagaccacattttgcttatccattcatttgttgatggatgcttggtttacttctaccttttggttgttgtgaataaagctgctataaacatgggtgtacaaataactgtttgtgaccctattgtcaggctttttgagtgcaaatccagaagtaggattgctggattatgtggtaattccatttttaattttttgaggaatcatcactatacggtttttcacagcagcgacaccattttacattcccatccatagtgcacagccattccaatgtctctatatacttgctcactcttactttctgtttggatttcctaggatcttaacctccagaaaacataaacaaaagaagtgcatgatactgtatcacttactgtcatagattttaatgaatatatctgaaaattcgtttcaaactaagagctattcccaaatattcaacatctactgttctttgcttgataggagccacaaccactctctcctaaaaccaagctttttggttacaagtgatttctgtgtctgcaggtaaggttacagctggctttgtggttagtaaataatctcttggtaacagacttgcttcatctgtaggtgactgtatgaagtcaggccgagggctgagtcagacagctcagctgagctgctctggtggcgtgccatgagagtgtcacagccatatctggagcagattaacaagaaatgtaaattcccttccaaaaatagattccaagaagtagagaacttttaaaattactttctataggaatttccatgatgcctgaagctctaattaaaaagacttataaactctagctaggtaaagaatttttgaaaaactcttcctgcattctctatgtaagaataatacctagtgcttttttaaaataataataataagaagaagaataagaatattttgtgctgttattttcttgggcaaaaatttttagaaggctggaacaatcttgtaattttattctctagccttccaccattcctttacttataaaaaatagcattttaattaaaataatcctgaattccatgcaagattaaacacatgagaatagtcagcaatcttttggaacaaaaaaaaagaataaagagtgactttcactgtcagacacctaagtgtattatgaagcaacaatgatgaaaactaagtgataatcagcccatgggaataagtgcatagtccagaaaggaaaaaatgtccataaaatcattttggtatttaaagcaatggagcaattatgacctatttgatgaagacagtattatatgaacaagtggttaagccactagagaaagataaagttaggttcccattgtctcagaatttacatggaaattaattaaaatatgaaacaagtcttagtaaagatacagaacaataaaaacttccattccttactggtgagactgaaaataatacagctattctggaaaacagtatgccaacttattacgaagttaaacatacattgtgtctgtggtccagcaattctactcctgttatttgtccaagaaatatgaaagcatgttcccacaaaaagactgttataaaaatgctcacagtagctttatttataatagcccaaaatatgtaacaacatgggtgaaacaaaaaaacactgcattaggaagaaggccagacacaacaaagaatgcactatatgactacattcataggaagttttagaataggccaagttaacctatggtgatagaaatcagaagaggaatgtcctgaggcctgcagggtttatgggaagaatgaactagaacaggacatgagggccctttctcagggaagagaaatgttctacattttgattgtaatcatggttacatgaggcatgtattttccaaaacttgtcagtacaaactttataagtctcttatgtatctcaataaaaattaattgggaaaggtttaacatttaaaggaaaagactgacaaatataactacttcaaaatttaaatttctgtaggatcaaaaagactataaataaaagatgagtaataatgagaaaaaaatcattgactatgagacttagtttagtttaattaaatttaattaatttagagagaaatctcaaaattgaaaaaacatgaaaaactgatgaacatctgaaaggaaaaatgaacaaaagttataaataggcaatttgtgaaagaaatatataagccccaaacaaaatttaaacaaaattttaaatgtgtgatgggccaagggctaatatatctctaatgtaaaagggtttatagaaataggtagaaaatactgtatatttggatttttaaaaagcaggcaaaatataggaataaacaattcacaagaaaaaacacacactcaataagtgtcttaaagtgtctagactctctagaaatcaaggaaatacaaattaaaacaactacataccatgtctgaccctgcttctgctttttcctgcctctgtggttttctctttttttttttttttaatttgtttgtttttccttttcagaaccactgattctcaactcaatgcctgggaaacttttattaatgttcaagttatcaacttggacaccacttctcaggtagcttcccctgactctcaatgctaataggagccctgctttgcaatgctataccactcagtacgtcccctagcagagcacttatcacactgcacttactatccagttttcctacaatccccacaaaatcagttctgtaagggcaatgctacagtccaagtgcctaccaagcacagtacctggcacatataggtgcttaataaatattccttgaatgttttattgagtaatatagcattttcaaattgggaaaagctaaagaaaattatcgagtatcagcaagatttaagttgtggcactttcactcactactggtagaagcataaacagttataatgttttctgaagatgtagtagatggagttctccagagcaactgaaccaatcgcatatgtagagagaaataatttaccaaaaagaattggcacacatgattacgtccaagatctgcagctggccagctggagaccagggcagccgatgggataagttctactctgagtctgagtctaactcctaaagcaggagaagatcaatgtccttcctcaaagacaagcagggaaaaataattctttcttgctcagcctttgatactattaagggcttcagaaaattgcatgaggcccagccacgttggagagggcaatctgattgactccaacctgtgattctaatgttaatctcatccagaaactccctcacagacacatccagaaataatgtgtaaccaaatatccgggcaccctgtggcccagtcaagttgacatataaaatcaaccactgcagaaggtaatttgccaacatttaatagaactcataaaaatgcttaacttttttgacctggcagttcagtcttgaacaatgttttctaagaaaattatcagaaatatgtctctgaatacctgttaatggcatctctttgttcattggttgtaagataaaacaaccttaagagtgattgaataaattataaattacaataaaatataattcaaaacttaacgatgatatataatatagacttgcaattattgatataaaaacatattcacaatatgttaaatttaaaagtctatcaataaagacaattgtaatatgatctaattttaattttaaatatacaatatatacaatacaaaatatacaataaaacttccagaaacttaaaatgtagtgtgtcttctttgggtctgaaattatgcatgagtttttttaatttttcttttcattttatgatcctgatatttcctagttttaatttcaatttaattaattcaattaatcatgtaatttcaaacaaccaaaaaactaaccatgtgctttgaaagcttgacttacataggctacatctcaaaagtctgttccactcaggattaaaattaaagcaattagcttagttagatccttttcccttaagcgtttcatttgctgtctactaaaaataccgagctctgattgctttgctcaccagcctaaactattcctcctgatagagcctcagcaggacaagagacaagatgatgtttaggtagaggattgaaagtgatctgaaaaactgacaggtgtggtgtggtatatccatacaatgaaatattcagcctcaaaaaggagaaaatttttgacccatgctacaacatggaggacattaagctgagtgaaacaacccagactcatgaagacagacgctgtattatttcaggaacatgaagttcctagagtagttaaattcttagagaaagtagaatggtggtcagcaggggctggcggggagtggggaatggggagttacttaatgagtgcagggtttctgttttgcaaaataaaaagagttctggagatctgtcacacaacaatgtgaatgcacttagtgttactgaactgtacactgaaaaaagattaaaatggtaaattttatgttatgtatattttactgtaacttaaacaacaaagctgacatatctgactgggggaaaaatcagagtcacacagacttgacttgttgaaggatttagaactgatgagggctgacacagtggctcagtcttcctgccaaatccagggctcctccccttcatcccgccacctttcagaagctgagctctaggcacatcagagcaattaagacagatacttctatattctcaatctatcacccctggaatgaaagcaataatagtagctaacacatacagggtgctgactatttgccaggtagtattcagaaaacactttacatgcattgaccagataattctcacaactctgtgagggaagaattattatgaaatctcattttacagatgaggagcctgtgtctcagagaggttaagtaattttcccaagggcacgcagcctgcagtgggatagctacaatgcaaacgcacgcattatagccctagaatccatgtatataactgttgtaaccatgattcttatactttaaggaatcacctgaaagatttctcaaagctgtttcctggactccatcccaagagagtagttggtgttagggcccgtgaatgtgcctctttgacaagctcaccggtgctgccagtgctgctcggctgagagctgcatgctgagtggaacaaggattgcagcacactgtaagtgttgcaataaagcaccccagttatgttctggaattaaatctagtaaataatcaataatggatgagttacccgtggatcaaattaatttaccccaaatgacttgctattgatatgctcgtatttggtagcaatgtgagttgataatccaatttaaaagctgttacttattcaactctattgcagcaagtatgaggcaatgtgttctcatgacaagacggctgggaatctagagaaatgcaaaaccaaggaatatcatttagtgtaaaaccaccataacagcacaacacggtcttttaatcactacagcatcattttcagatgttacagaagttacagtatgactatagcattccacaaaatcctcacactccccttgctctcagtctatactctgcctttccagaagaggttgccttggatacaagtattgtcatgcctgtaaattttatcccctgtggcaagttagcaaattggcatccaggtttaataaatctgtctgttattaatgaataaatctagtctttctagcaagactcatacccacaatgcttgataacctctgagaaaatgggtaaaaccagttggtggactctcaaagtggacaattgcaccctacacccgtgtgacccaggggagcacagggaccccatgaactactcccccatgggaatgagtagtatccctctctcttgagactctgggactgcagttagtgaggttgggttctgaaaagatgctttcacatccccaattatgactaccactctagacttagaccagctgccctagggagaagaatgacagccccacatttaataatagatctcaggtttcaccttcctcactaggaacaatccgctcagcttagaagctctggagctgttttcccacaccgcaaggtcttctatcggtttgagagcccctggagatggcccacgctggtggcaacgaggcatagagagtcacacgagatcacttagctccccagtcaggtctactgcagtatgagaaacaggggagggaaatgttagctatttaaagatactagaaagaaaaacacatggcgtgaacatttttattaggtcataaggggtcaggcctaatagaagattatcactttattactggattccattttatattaccctgcctgaacaagactctcacgatagcaccaacagatttggctttaatgacttctccctcataatttctaatcacctacacttaaggaccattccccaccacaggaaagtgatggtggggaaatacttcactgcagtgaagacccttaaactcccaagattcagactcacctccctgagccccgagctcaccagtgagtccctcaagactgggtaatgaataacaccaagcattcatctatgaaggagttcctaaataggatgaagtagttaaaaatattttttaagaataattaaaaggcattatggaaaatcctgaaatatttcttttttttttttttttttttgagacagcgtctggctctgttgcccaggctggagtgcagtggcgcgatctcggctcactgcaagctctgcctcctgggttcatgccattctcctgcctcagcctctcaagtagctgggactacaggagcccgccaccgctcccggctaattttttttttttttttttttttttgtatttttagtagagacggggtttcactgtgttagccaggatggtctcaatctcctgacctcatgatccacccgcctcggcctcccaaagtgctgggattacaggcgtgagccaccacgcccggcctgaaatatttctaaacagataaaaaatagggtcaaatatgaactcattcttccttatatagaacatgtcctactagtcactaaggtgcccaggtttcttaattggtttgttctttgagctaatacctaaaagatgactaacatgggaaatgaaacccaatggccgcaacgtccttaaaacccatgcatccaaacatcctgtgcctctgggtagtctatggcaggctgaatgacagtcccccttggatatccctgtcttaatccctaggacttgtgactatgtcaccatacatggcaaaagggactttgcagatatgattaaggctacatatcttgagatgggaaaaaaatgacccttgattatctgagtggatccagtctaattgcatgagttcttaaaataggaaggggaatcaagggaagtgtatcacagagacagcagcatgaggattcagtgcaaatggctggttctgtgaggtaggaaccacatgcaaggatctgagaaaagttataggagctcagggcagccttcacttgacagccagcaagcaaatagggacctcagtcctacacccgtaggaactaaattttgccaacacctgaatgaacaaggtgatctttttctcctagaatctcaagaaaggaacacagcactgccaacatcttcatttcaggttagggaaatctgtactggatttaaagaattagaaaataataattttttgttgttttaacctactacatttttggtcatttgttatggcagcaacataaaactaatgcacagttttcatccaagttatacttctaattaaaaccttaccactttaacaaatcctgttctttctagccacagcctcttagcatgaactccagtttctttttgtaaagtaatcctctataaccttttatactaaactttctatactaaaagcatcagtagatttccttgctgtatttcagcccaaattagctgggcttgactaatcacagcagggtcatttaggagtgacataatcctaaacacaatcctgaaggtgaatgcatgctctcttttctgacattaaaggtggtttcaatcacgtctggcaccgactgaaaaaatgtattctggaatgcctcaggatgaaggaaagaaaaacatagatactgatcttccaacatcgcaatctggttctaatatcagttgtctacaggaagaattcactgttagagaatgatttcctcaagtctatttttaagatccctttaatgtagccatctgctaaattatcttgatacaaatgaggagaatttcagtgaacatctgaatttccttgtttataaaacgaaaactagatcacattccttatctagcctggtgataagaactaatttgatgtatacatatatcagtgtgtgtacgtaaatcatatacacagatttatactacatatacacacatgtgcaccaatcaggataagctagtttatgctgcatcattatctctgcctcaaacaaaccacccaaacttagtgcctgaaacagctcaggtttactccctcccagttctgtgtatcagctgtttggagtggatttggctagaggttcttctgttggtttcaccaggggtcactcatgtagccgcaccatggggtagcatggtccaagacaaatccattcacatgcctgcttgtgggtgctggcagtcagcagaagttgtgaagcctcagaaggcttttactcagaacagcctccatgccatttctcagtcccctttgatgtaagcaagtcacaaatccagcctaattccaaacgggtagagaaagaaaatctactccttgatgagaagagcaataagtcacattgcaaaaaggcacacacggtggtgggaagaatctgttgctatttcaataatccatcattacccccaaatatcaaagatttatttttattcccactgcatggccatcgtggttcactgggggctctgctgcccattactgctcattccaaaatgcaaagtgatggatgattctgccacgcagagcatgctgtgctggttatcagaaccaaggggaaaatgtcagagaagtggcctgcaggaaatgaaatacttccatccaggagtgacagttgtcactcccagccaactctaagtaagtcatatggccacatctaactccagcggagttggaggtgatttcttacaggtgcctgaaagaggagagctcaagtgagaataagtagatcaaacaggtagcacaacatacatgcatgctctcacacacacccatacgtgacatcaatctaatagtttgtcacaggcagctcaaacatttggaactacccaaaactctatccgtgttctggaaatgatagtctctgactataactcagttaagaaagaacaagaagattgatagtgtttttgtcatttccgtaagaaattttgttaagaatactctttcttatttgttccagagataatgatataaatagaattcacttgtcaatacccaattacttttgatcagacatggagggattctatctacaaactgaatcaaaaaatcaattgtcattttgaagtcagtacattatcatttctttgtaattcaaagctgtggtagttagggctgttctcaaatggtctttttctccttctggttgtactttcatccacttaaatgtgatcatgtgactttctttagtcaatacaattctacgttatatttgcatgctattctatactataaagcattattatatataaaaactcataaagttatcaggataataattggaaattagcttaatctcatgcaaactgcaaaaaaagatgattctacaaacaatatatgtgctaaaagaaaaaatgacaagataaataatactgaatcactacaatctccaactaaaattgtctgactcaactaaggcaataaatttttaaaaactgaaatcaaagtagaaatatattttaattgtattatatttcttaatgttttcttatatttaatgttagaatatttgcaagtctacaatggaggaggagagatttataaattccagctgcctataatagctcaactttttcagagacgtaaatttttttcttctaagaagaagtttttcacttcatgtagaagattatactaatatttacctgaacccaaattagggaaggtttatgtcgttgttgtttaacttaatatgctacccacgttaattagctatactgagcttgctttcttattttctcttagtatcccacatttataaagctatgtgctattctcaaaaagttttaggtagcagtccttgtaaggagttgaatgtgacactcagaaaaatctctagaactggtgaatgcaactttatttggatagaaagttttgcaaatgtaattaggttaaaaattttgagatgagattatcctgggttacccaggtaagccctacatccaacaaccagtgtcctgataagagacacagagaagaggggaaggctgtgcacagacagaggcagagactgaagcaatgcatctataagccaaggaatgccaacaattgcccacggctcccagaagctaggcagaggcatggaaaagatttccctcagagcctccaaaaggcaccaacactatcgacaccttgattttggacttctcatctccaggactgtgagataatacatttctgttattttaagtcatggaagtttgtggtggtttgttgtggcactcctaggaaactcagcagcccctatcgaaccatgcctccctcatcgccccaggctggctttcccttccacctcttctatattggcactccccaacaagcgagcagggccatcatctctgaattaacactatctagaattcatttcaccgtctagcctcctttgagttctgcagaaaagcagaggttgttatatcaaatacatcagatgtcaattgcaaatgtaaatttttaatcgtgtttcctttaggtgctgtgatgcatttgatgcagaaacagttgagctctactctaaatgcagagtacaagggacaggggagaaagaaaaatgagccatgcacagtccctccccttccaggcagctatatgaacatgtaagctataaaccacggtatatattccataacgatttccattttctttgctcctgttctgttttccaggactgaaagttgcctctagaagatgccacagtctgctgtcagttattttcttccacccattaaaatgcaaattggtatttctatgtaacatgtgacaggtttggataaaccgtgggattctctcctctcaattctttactgattgaattttaatctggattgcctatcaaaactcagcctattccttgaagttcagataaagtgtcacatccacaattaaaggtctcactgttacccccttacaatgcactttttatacctgagaaatgtgattacatttatttaacttactatgtttcgggcaccatgatttcatttaatcttcagggaacacacctaccattagatactctttacaaatgaggaaacaaacttggcagtgttcaggaacttgtctaaagtaattgtattagtgagctagagatgcataacaaagtcccataaacttaacagctgaaaacaccaatttattttctcatagttctgccagtcaggagtccaacacagaacagatggattctcttctcagcctcttacaaggtgtcagctgggccacattcttttctggaagatccacttccaggctcctccttgttgttggcagaattcaacagtggtagaactgaggtcccattctttgacacatgacctccatctgtgagcaagccatgacatatcaagccctgctcatgccttggttctctctggcttcctctctctgcttttaagggctcctgctcctgcgataacatcgaggccatctgaacaatccaggataatctcctcatctcgaaatcaactgattagtagccctaattacatctacaaagtctcttttccatgtacagtaacatttccctgggtttggcatcctatcatctcagttcccagtgattggggtgtggaatgttcttgggccacgattctgcttaccatagtcactcacaatcagtaagggacagaccagggatttaaacccaaatttgttttagtctttgtaccatgtcctgcttcctctctaggacacaccttaaactaaagctgcagatgttggtgagaagagagagtgtgatgtctaagaccacagcctctgggcagccctgcctgaaggcaaatcctcagccctctcatcagtagaatgagtataaaataatgtctgcctctagggttgttatgagaattcagcggcttaatactcgaaaagggcttgtttattactttgtctggcatatagttagcattgtagaagagatgttaaataaataaaagtaaaggaacataaggcaggagagtaaaagaacagcagtgtagaaggcattttgcccattttattataccatgataattcacaacgttttaaaaggtgaaatatttgtaattgtaacattaccctacttttgagctaatagtttaagatgtagccttgctaggtttcaacctatttttggacaaggagtatgacttatatgcattagatacttactaatcaatcagggagttgaactggattcaggaaagttatataacaagaacttcatgattctttttttttaatattgcctatttccaggcagattattagtggaaaaataattataaggagagatttttcaaaatatgtttaaaagcttttgtttttaaaatgaatttggagagagttctatttattgaagcagatgctctgactggaagcaaaatcaaaatctaattaagaaagagttacaacaatctccatgactgagagacccttgatgggcctagggcactagagctgacataacaatagatgctgggtctgatgtgtgatagggagggctctatgaagctcacatctgcccctaaaatgccacatcccctggccaaccacagctatgctcttaatgtctacaaaatatcttcattgatgttcattatatctgggaggaacaaggggcttcatcaatgaaagagcatccaggaatttatcagatggttgagaggaatgaaagcctgatttcttccttgatgatgatacttacagaaaacagattcaaatttgctagtaaaatcatagcagtgagtaagagtaggaaaaaaataggtggtgcatcttcctattgctgggtggggtgggggcaaaggaaacaaaaactagatctgcagataatagggaaatgaaagaaaagaaagaagaaaacagaaagcaagaaacaagaaggcaaaactaacaggtaacatcagttacaacaacaaatgtgagctgaattcaattacaaaacaaaagattcacagcatcataaaggaaattctattatatactatcccaagtgtatcccacctaaaataaaatgatatgtggtttaaaaataaagtgatgggtaaaatatattaggtacacgaaatcaaacacagaaaagtagagatagcgatattaactaaaaaatcaagctcaaggcaaattttttttaaaaaaagataaaaaaggtccttatatgagtataacaggcatgttccaaaataaaactacatgagacatgaaatattttttattgacttcttgagtccgtttttttctacaaattttaatacatgcataccatgtgcctggcattctgttgaaaactagaaacacatttaaactagacataattacagtcaggactttaaaagtttagatttcaacactcccacttctgcctcaacttgcagcttcctgttgtccaggaaaacaccctgatggcagggtgggcaactctacctacccccacctctcgtagccaggaaagctttacctgttagagcttccagcctagaggctctacctctgcctgaatttgccaaagggtacagcctcctgttgccctggaaatacctggattgcaggacgggcaactctatccaccttacttcttgtagccagatgggccacacctgctagagcttcctgcccagtggcctcacttttgtctgaattctgcaggcaggcataaccgtatgttccccttatccccacttggacagtagatttgggttgacctggaaaggatatagcctgtctgccagctttggcccctgcccgagggagacacatggagcagaacacccaacaaaagaaatgtgggcatgaagacagtaatcaaagagggctcctccaagacccaggagtgaactaaaattgaagccagtcaactgaacccactttatatcacaaagaaacccccaagagcatcaaagaaaataaaaacaaagaaactcacccaaaggataacaaattcaaatactgaaggaacatcagcccacacagatgagaaagaaccaatgcaagaattatggcagctcaaaaagtcagagtgttttcttacctccaaacaaccgcactagttccccagcaatggttcttaaccaggctgaaatgtcagaaatagaatttagaatatggataagaacaaagatcattgacatcccggagaaagttaaaacccaatgcaaggaatctaaggaatgcagtaacatgatgcaggagataaaaaacaaaatggccatattaagaaagaaccaaactgatctgatagagttgaaaaaatcacttcaagaatttcgtaatataacacaaatatcaacagcagaatctgccaagctgaggaaagaatctcagagctccaagagcagttgtctgaaataactcagataaaaataaataaaacaataaggaagaatgacaaaaactttgagaaatatgggactatgtagagaccaaacctaattctcactggcatccctgaaagaaagggagagaaagcaagcaattagaaaacatgtttgaaaatatccttaattaaaattttcccaaccttctagaaaagccaatattcaatcaagaaaatgcagagaacccctgcaagataccttacaagatggcaattcccaggacactaatcatcagatcctccaagatcaaaatgaaagaaaaaaatgttaaagacagccagagagaaggggcaggtcacctacaaagggaactccatcaggctcacagcagacctttcagcagaagccttacaagccagaagagattagaggcctacattcagcattcttaaaggagaataatttcaaccaagaattttatatctggccaaattaagattcataagaaaaggagaaataagatccttttcagatatggaaatgttatgggaatttgttaccactagacctgccttactagaggtccttaagcaagtgctaaatatggaaagcaaagaccattactagctagcacaaaagcacacttaagtacaaagaccatcagcactattaaaaaaaaaaccacacaatcaagtctgcataataaccagctaacaacatgatgacaggatcaaacttgcacatatcaatattaaccttgaatttaaatgggctaaacacctcaattaaaaggcagagtgacaagttgtataaagaagcaagacccaactatatgctgtctataagagacctgtctaacatataatgacactcataggctcaaaataaagggatagagaaacactggcaaagcaaatggaaaacagagaaaaagcaggagttgctattctaatttcagacaaagcagagtttaaatcagcaataatcaaaaaagacaaagaggggaatgacagaatggtaaagggttcaatccaaaagaagacctaactatcctataaatgtgcagccaacacaggagcacccagattcattaacgaagttcttagacaccgacaaagagactttgataaccatacgataatagtgggaaaattcaacatgccactgacagtattagacagatcatcaaggcagaaaactaacaaacgttttcaggacttgatctcaacatttgaccaaatggacctaagaaacatctacagaactctgtaccccaaaacaacagaatatatagtcttctcatctgcacattgcacatacctctaaaatcaaccacacaatggccataaactgtcctcagcaaattttaaacaaccaaaattataccaaacacactctcagaccacagcacaataaaaatagaaatcaatactaagaaaatcactgaaacccatacaattacatggaaattaaacaacctgcttctgaatgacttttgggtgaacaatgaaattaaagtagaaatcaagaaattctttgaaactaatgaaaacaaagatacagcacactagaatctctgggacacagctaaaacagtgttaagagggaagtttacagctgcaaaggcccacatcaaaaagttagaaagatctcagattaacaactaacatcacagctagagggaccagagaaacaagactgaaccacccccaaacctggttttgaaataaccaaaagcaaaactgaactgaaggaaattgagacacaaaaaaacatataaaagatcaaagaatctacaaattgattttttgaaagaataagtaagattgttagaccactagctagaataattttaaaagagagaagataaaaataaacacaatgagaaataaaaaggggctactactaccaaccccacagaaatacaaaaaaaccctcagagactactatgaacacctctatgcacacaaattagaaaaactagaggaaatagataaactcctgcaaacatataacctcccaaaattgaaccaggaagaaattaaatccctgaacagatcaataatgagttgtattaaatcaagtttagcctaaagatgcctccttacattttttaagtttggcctaaagggttctctgttcatagtgaatataacctaaatggaggtgtaaacagactgtaatttactcttgtgccaatcactgagttttgaccaatcaaagagggcaaatgttgaaactgtatttaaataagacaaatgctgagctgtttctgtatcttactactgttttctgtatatcattttccttgttctgtctataaatcttcttccaccatgtggctgcactggcatctctctgagcctactctggctcaggaggctgcccacttcatgaatcattctttgcttaaataaactctgttaaatttaatttggctaaggtttcttttttaacagttccaaaactgaagcagtaataaaaagcctgccaaccagaaaaagcttagaaccagatggattcacagccaaattctaccagatgtataacgaagagctggtatcatttctactgaaactattccaaaaaattaagaaggaaggactcctccctaactcattgtatgaagccagcatcatcctgaaaccaaaacctggcaaagatacaacaaaaaaagaaaactttaggtcaatagctttgataaacataggtgcaaaactcctcaacaaaatactagaaaaccaaatccagcagcacatcaaaaagctaatccaccatgatcaagtagactttattcctggggtgcaaggttggttcaacttatgtaaatcaataaatgtgattcaccacataaacagaactacaaacaaaaagcacatgattatctcaatagatgtagaaaaggcttttgataaaattcagcatcacttcatgttaaaatctctcaacaaagtaggcattgaaggaacatacttcaaaataataagagccatttatgacaaacccacagccaacattgtactgaatgggcaaaagctgggagcattccctttgaaaaccagaacaagacaaggatttcaactctcaccgctcctattcaacacagtactgaaaattctagccagaaaaatcaggcaagagaaataaagaaaagccatccaaataggaagagaggaagtcaaactatctctgttgacagacaatatgatttacacctagaaaatcccatagtccctgaccgaagcttctagatatgataaacaacttcagcaaagtttcaggatacaaaatcaatgtaaaaaatcagcagcatttccatacatcaacaatgtccaagctgagagccaaatcaagaatgtaatcccattcatgatagccacaaaaagaataaaatacctaagaatatagctaaccaggtatatgaaagatctctacaatgagaattacaaaacactgcttaaagaactcagagataaaaaaaacaaatggaaaaatatcccatgttcatggacaggaactatcaatatcactaaaatggccatattgcccgaagcaatttacagattcaatgctattcctatcaaactaccagcatcattcttcacaaaactagaaaaaaaactattttaaaattcatatggaaccaaaaaagagctccaatagccaaggcaatcctaagcaaaaaaaataataataaagctggaggcatcacattactcaacttcaaactatactaaaacacaacagtaaacaaaccagcatggtaccagtacaaaaacaggcacatagatcaatgggacagagcccagaaataatacctcacacctaccaccaagtgatctttgatgaagtcaacaaaaacaagcaataggggaaggactccctattcaataaatgatggtgggataactgattagccatatgtagaagattgatgccggaccccttccttacatcatatacaaaatttaactgatgataaatccaagagttaaatataaaacctaaaactgtaaaaacccttgaagataacctaggacatgccattctgaacataggccctgacaaaggtttcatgatgaagatgccaaaagcaattgcaacaaaaacaagaattgacaaatgggatctaattaagagcttccgcatacaaaacacacaatcaacagagtaaaagacaacctacagaacaggagaaaatatttgcaacctatgcatctgacaaagttctaatgtccagaatctatacggaactcaaacaaatttacaaccaaaaaacaaacgaccccatcaaaaagtgggcaaggacataaacagacattttcaagagaagacatacacacaatcaacaatcatctgaaaaaatgctcaatatcactaataattagacaaatgcaaatcaataccacaatgagatactgtctcacaccagtaaaaatggctactaataaaaagtaaaaaataacagatgctgccaatgttgcagagaaaagggaatgtttatatactgctggttgaaatgtaaattagttcagtcattgtgaaaagcagtgtggtgatttttcaaagaacttatctttgaaaagttcaaaagaagtatcatttgacctggcaatcccattattgggtatatacccaaaggaatagaaatcattctcccgtaaagacacatgcacatgtaagttcattgcagcactagtcacaatagcaaagatatggaatcaacccaaatgcccaccaatggcagactggataaagaaaaggtagtacatatacaccatggaatactacatagcatattaagaataagatcatgtcctttgcagcaacatggaggaagctagaggcattaccctaagcaaactaatgcaggaaaagaaaaccacatattgcatgttctcatttataagtgggagctaaacattcattacacatgaacacaaagaagggaacaatagacactgcggcctacttaagggtggatggtgggaggagggagaggatcaaaaaactacctagtgggtactactattcttattacctgggtgatgaaataatctgtacaccaagcccatgtgacatgcaatttaccttataacaaactgcacatttacccctgaagctaaaataaaagctaataaataaataaaatgtttaggcttaagggtacattaatatgatcataatttaaatatatgtgcagaagaaagccagtggaaggagatacaacaaagcctgtgtaggcattatggtttctttttcttatttatgcttttacttattttataattttctacactaataaatgttataaaatcatcacatatttgtatctaagtggcttctttaaaccctactcactattttttatttataaatactgaaattcaaacaaagtataaaaatcaaaataagtattttaagagatttttaaaattatatattttattttatttcttagccaataagagaagctgaaaaaaaaaacagaatttatccagaaaaaggggaatgaaaaagtttagcgttaccagaggtttgcttttccagttcagatccctctcttggggatcagcaatgaaggcaatagggcaaggaatttcacctgtgcacaaacgaaattcttcttgctgtcccttgtggcacttctccataccctgtctaatggaatggctctgaaacaactgaggctgctccccaggcccagcaaagctcatcccctaaatgagagcaggaagaaatagctgcagcccaatccctgcacccacccattggctcccacccaatgctccagcctctgcctaagccaggagatgctggaggctctgctgaaattttttcatgcgcttctgagaagaggtgatccttcacaaatcatgacatcagcaatatggtcctctcaaagtgtctggcatttggatgcctatcttctctagtttccaatgctgatacagagattgaacatagacatatatgtaacaaaactatggaatagacccaataactgtattttatatgccagctatgtcaggacctactggagagtcaggtcccctatgttcacttgccatttagtcttcaataaagcagtatatgatgatagtatattatgaaatatttcaaatacttaaaaagatatgcaggatattatgataaacaatagtatatcaaccacatggcttaagaaacaaataagtacatcccacatggtcctacacaccatataatccaaatacaatttatcttcccctggcataatgtttatataaaaattatatatggttagaacctggggccagatggtataggcttaagtgtaatctctaccacacaattaagtaatcttaaataagttaccttacctttccatgcttctgttcatcatccatattatgagctgataatagtgtatacctcacaaagatgtatgaatattatgtgggtttaatatatgtaattgtatttaattacatatacatgcattcagttacatatattaactagaattctacagtcctgaagatcatttcttaattatactactttcttaattagactactatctttctaacttctattccatttttcacataacccagaaattcactatttaaaaattaaattatgggaacaagggaagaacatctctctcctcacttctattcaagatcatactgggagttctagctggtgcaataatacaagaaaagaaaattaagggtatatgggctggaaaaggaaaaataaaactgtagctgacattcttgtgtatgtaaaaaattttaaagaatcagcaattaaaaaatcataatgctaataagtcgttatagcaagattgaggatacaaggttaatttacaaaaatttatatacatatgaacaattgaaatttgatattaaaaataaaagcccacttataataacaccccaaaatgaaatcatatatatatatatatatctaatatatatatgtaatttatgtacagaaaactctgatgaaataaatcaaagaagatcaaaataagtggagagatagtctatgttcacagattggaagaatcaatgttaatatgctaatatattccaacttgatccatagagtcatcctaatcccaatcaaaatcccagcaggctattttgtagatatcaacaaacttattctacaatatatatgtatagaaacacaattcattcttgtatgtttattagtaccctgcaactttactgaatccattaattatttttttctttttcttttttttttttttttgagatggagtcttgctttgttgccagactggagtgcagtggcgtaatcttggctcactgcaacctccacctcctgggttcaagtgattctcctgcctcagcctcctgagtagctgggaccacaggtgtgcaccaccacacccagctaatttttgtatttttagcagagatgaggtttcaccatgttggccaggatggtctcaatctcttgacctcgtgatccacccacctagatctcccaaagtgctgggattacaggcatgagccaccatgccctgccccatttattatttctaacaggtttttcttgtgtgtgtgtgtacagactctgagattttccacatataagatcacgccatctgcaaacagaaatcattttacttcttccttctagaggtgtatgacttttattacattttcttgtctaattgctctggctaggaattccagtgttatgttgaattaagtggtacgagtgggaatccttgtcttgcttatgatcttagaagaaaagcttctagtttttcaccattgaatatgatattagctatgggattttaaatatagcctttactatgttgagataaattccttttattcctagcttgttgagagatttaattctaaaagggtgttaaaattttgtcaattttttgcatctatgaagattttcatgtgatttttaccttttattttattaatgtgccatatcacattaattgatttgcatacattgaaccatctttaaattccaaggataaatcccacttggtcatgagtatgatacttttgatgagctgttgaattcagtttgctggtattttgttgaggaaaagaaaactatatatggaaatgccaaagacagaatatccaatacaatgctgaagaagaacaaagctggagaactgactgacttcaaaacttactaaaaaactgcagcaatcaagatagagtgggatgagtgaaagaacacacacagatgaattgaatataacagaaggcccagaaatagacctacacaaaatattcaattgagtttaactatggagcaaatttaattcaacgaagaaaggattgtcttttcaacaaatagtgctggaaaaattgggtatacatacatacatacacaaaaatatagacatagaccttataacttttactaaaactcatgcaaaatagattataaatccaaatataaaatgcaatactacaaaacttctagaagaaaacataggagaaaaatctatgaaaccttggatttggaaataagattttagatacaataccaaaatgtaatccataagagaaaaatttgataaattagactttattaaaatttaaaatattggcttatgaaaaaaacagttttggtgggagtataaattagttcagccattatggaagacagtgtggctattcctcaaagactaaaacaagaaataccattcaacccagcaatcacattactgggtttttacccaaagaaatataaattattctaccataaagacacatgcacatgtatgttcaatgcagcactattcataatagcaatcacatggaatcaacctaaatgcctatcagtgatagactggataaagaaaatgtagtagatacacacaatggaatactatgcagccataaaaaagaatgagatcatgtactttgtgggaacacggatggagctggaaaccattatcgttagcaaactaactcagggacagaaaaccaaatactgcatgttctcatttgtatgtgggagctaaatgatgagaacacatggacacatagaccggaacaacacacaataacacctattggagggtgaagggtgggaggagggagaggatcaggaaaaacaactaaggggtactggcttaatacctgggtgatgaaataatctgtacaacaaatccccatgacacaagttcacctatgtaacaacaaacctgtacttgtacccttgaacttaaaataaagttacaaaaaagagaaccaaaagacaagacagaattaaaaaaaaaaaatttgcaggcctcatatcttaaaaagcatctgtatttcaaatgtacaaaaaactgaaccgatacctcaccaaagaagattagacaaaccaaaggcaaacaagcatgtgaaaagataatcagcatcatacatgattatgaaaatccaaattaaaacattatgttactactacacacctattagagtggcaagaatccaaaacattgacaacactaaatgctggcaagaatgcaaagtgaaaggaactctcattgatagctagtaggaatagaaaatggtacagccactttagaagacagttcgacagttcctcacaaagctaaatgtagtctcatcatatgatccagtgatgctcgcaggtattcacccaattgattagaaaacttatgtccatacaagagcacacatgtgaatgtttcatagcaaccttattcataatcactaaaaaatggaaacaactagttaggcatggtggctcatgcctataatcccaactaaatgggcagctgaggtgggaagattgcttgagcccaggagttcaaagctgcagtgcaaaatttttggaatctatccatctgacaaaagtctaatatacagaatttacaaggaacttaaacatatttacaaaaagacaaacaaccccattaaaaaaatgggcaaaggacatgaacagacatttctcaaaagaagacattaatgcagctaacaaacatatgaaaaaaacctcaacatcactgatcattagagaatgcaaatcaaaaccacagtgagatactatctcatgccaatcagaatggtggtgattaaaaagtcaagaaacaacagatgctggtgagtttgcagagaaaagggaatccttttatactgttggtgggaatgtaaattagttcaacagttgtagaagacagtgtggtgattcctcaaagacctagaaggagaaataccatttgacccagcaatcctattactgggtatatacccaaaggaatatagatcattctatcataaatatacatgcatgcatatgttcattgcagcactattcacagtagcaaagacatggaatcaacccaaatgcccatcaatgacagactggataaagaaaatgtggtacatacacaccatggaatattatgcaatcataaaaagcaatgagattatgtcctttgcagggacacagatggacctggaagctgttatcctcagcaaactaacacaggaacagaaaatcaaacaccgcatgttctcacttacaaacgggagctgaccgatgagaacatatggacacatggtggggaacaacacacactggagcctgttggggggtttgggggagggagaggatcaggaataatagccaatggatgctgggcttaataccaaggtgatgggttgatgtgtgcagcgaatcaccatggcacatgtttacctatgtaacaaacttgtatatcctgcacatgtaccctggaacttaaaataaaagttgatggaaaaaaatggtgtcttttaataggtgagtggataaaataaactgcactgcacccagaaaatcaaatcttattcagcaataaaaataaatgaactatcaagccacacaaacatggagtgaccttaaatgcctattactaagtgaaatgagccaaactgcaaatgctacatcgtgtatgattccaaatacacgacattctataaaagacaaaagtataaggatggtaaaattatcagtgattgtcaggggacagggggaaaggaaggataatgggcgaagcacaggggatttttaggacagtaaaactattctaaataataccgtgatggcaaatacatgacattacgcatttctaaagcccgtagaattttatagcgcaaagaacgaaccttagtgaatatgaatttaaaagatcattttgaggttgggggatcccaggaagaaatttaaaccatgaccagagaatctaactgtactatgaatgtattaaccacatgggtaaaagtgagaagaaaagtttccgacttaagtgactttggaaatgagtaaagtctatgaaacaaaaggcaacaggaactgcccataaacactgtactctagttgataaagttatatcccaaaaataagggctaccaatgctgatactacttacatgtacactggaattgaacaattaaatgaatgtcagatggtggaatccaggtttctcactgtggaagtgagaatttatagacaaacaaggaggaggctagaatgatatatgtggaaaggaattagagttagagacatcagtgtgaactcatgtttagcttaatatggaaataaatggtaacatacataaatatttatagatacatgtatatatgaaggttagcatatgtccctatattcccttgctgtgtcagctgtgcaggtctaatgaaacaacatcccagtagcaatgaggacatgtagcacccagatcttaggttctaatatcattctccagtggaagaagccagggctccctggagaaatggctaattctagtactggggcaggaaatatacatgataagcctagagtatcttatagagtcagatagtaaggaagtgtttaaaggaaaaccccatattaatgggagtgtgtcaaaggcacccaggagccactgaaaaaagttcccaatgaccaaaagttgttaaagattgtgtacaccaaaagagttcttaatgaccaatttgaaaaacaaaataataaaatattactggactataacccaaagcatataataaatattcatgaggccgaagaggtgtaaataagtgattagtaattacatacatttataaatggggagaagagacagtcttacgggtggaagagttcctaataatttatgtagatattctttcctcaagaagggggagcataagttctactcccgaaagtgtgagttgtgcatagcaactatcttccaaaaactgcagtgtcgaaaggaagaaaaaaagaataactgtatagaggagaaacctgaaaaacactacctcaaacaggtgatcaagttcaacatcaacagccacaaatcatgttgataatatgtgcctttgataaaatgagattaaaaaatggcactttacttctgtggtcactcttcaaataatccatagccctactctcatcatgaaaaaaatcatcaaaaaattcccaataaaggggtatcctaaaaaacacctgaccagtattctccaaaactgccaaggtcatcagagacaacaaaaggatcagaaactgccacagtcaagagtaaactgagacatgccaattaaatctaacgtggtatcatggctgggcatggtggctcacgcctgtaatcttagcactttgggaggccaaggtgggcggatcacttgaggtcagaagttcaaaaccatcctggccaacatggaaaaaccctgtctctactaaaaataaaaaaaaataaaaaaattagccaggtatggtggcaggggcctgtaatcccaactgctcggaggcagaggcaggagaatcactagaacccaggaggcgggggctgcaatgagctgagatcgtgccactgcactccagcctgggtgacagagagagactccatctcaatcaatcaatcaatattttaaaaataaataataaaataataaaaataaatctaacatggtatcctgaatggactcttggaccagaaaaaggacactaggtataaatgaagcaaatctgagtaaagtatgcatttcaatataatagtgcattggattggttcattaattgtaacaaatgtactctattaatgtaagatgataaaaatagggaaaaatgggtgtggggcatatggggaccctctgtaatatcgtctaaatgattctttaaatctaaaaacatcctaaaaaattaaggtctattaaaaatttaagttagataatgaaaatttcctttaagccctttaatgtttcctattacttgccaggtaaaattgaaacttcatccttagtactgagtaccatctcttatctttctcccctttccaactcacacctgttcaacatttcaggggacttctcatgtttctgcaaaaaaaaaaaaaaaaaaagatgccctcccacaattacctgctttagagatatttcttctgcatgacattccattatcctagatctctctcagaaaatggcttatctttgaagattcagcttacttgctccctccttagacaagtcttctgtcaccctactataatggattgattgggaacctcttctctgtgcaatttggcaactagagattacaatttagtcctgcttctcagtgtggtccaggagccaacagcaataggcattaccagggagcttgttagaaatgccgaatctcaactcatcccaaaccaaaagaaacaaaagtggcattttaacaagatctccagattatttatagccatattacagtttaaaatgctttgagtatctagaatttagctctccttaagcccttagcacatggttctctggttgttttaattgcctgtgtccttgccaagttatgaaatcacctgaggacaagggttatgtctcattttttttctttatcttcaatatgatcacagtatctggaacattcaggataaccaaaatgaattaatgactagctgaaggacacattaaatgagagtatgtattacaaagctttacagtttttataggttaatacctaacactatttttccttgccaaaatttgtgaacaactgagagacagtcaagggtcagaaagatgatgtacaaaacatcaaatttattgccaacaaagcaggtttggcagaacatggctttgttgtgtagctaagcagctttttaatactttgcccagaattaggcagacaaaaagcttacctggggtttccctttgggggtggggatctgctcttggaaaacctaaggcatggaggagcagccctgccttgtgctttctgcaggcagaatccaaagaaagtagaaagagaagtgcctttcaccctgctcagcttcatctgccaaactcacagtcagcccgtcacccttccttctgtgtgaccctgatgaagaaataaatactccctgcacccagtgggaaattcagaggaaaaaaggagtgaggaggaacaaaaggataaaagagaaatacaacacaagaactatgatcatgatgattttaacatttcacagggcagatcatgcacctgacactgagaaagaatactgaaaggtgcttgatttttagcatgaggccctccaacctgccacactgtcaatcaaactagaactgcacatgtggattctgagggtttaaaatgcctcattcagcctacaaccccaatgaggacacccaaactaaagggtgtggttacaatcacagtgttttatttaccgctgccagtggcctcattgttttccaacaacttcttcctctattgactagaaaattacataatatgaaatgtaatgacatccttaacctgttcagtaagtatcaactctaagcaaccaacagtgatcagctaaattctgagggagccagggacgtaaaaagatcctttaatgtagtctaatacaaaatacaagggctcagagtattgttatttaaagtattatttattctttgccttttatataccattgaatactacaaaacttgtttttttcctgcaaacctttgggtaatttacattatagtataatatgtatcctaataatttaatattaatattatgtattataattgcttaataatctcatatgtattataatcttcaatcaggcagaatgccatattctataagttcccaagtctttttgaaatgccatttaacaaatgtgatttaaggtccatgtgtgtattaccctaagtgattaagatgatgatactcactagtcatacacatttcaaaaatacacacagtcaagtttatcaactaccataattttgaaagttttgattgctgatagtattgtcaaggaggaacagagtcctcgaggccagtggctttacccgtaagcctgcaacacatcctaatgctcaagcagacatgcaaggcttgtttcccctggtcctttggaaaaagatctatgttagcaacagaggatgggaaacacttagcatgcatggccatacacctctagctagtgcccttggcaggcattactaattgatcacagcagacttctcccttgacctggatgttgctttctcgagtcagagctcagggcagccactattaattgattggagtttgcatgtgaaataaaaactatctgatatcccatgggcttctatgagctggaaactttctctttctccttcccccaaccccaacccaaaacatagctgtgtgtagatgcctcagcctctgatttggttgtgtgtgatctttttccaatgtcagctcaaggttttgattctttactgtcaggttgccagcatctacggaagtgtgtggcatatatttgttacaagaatgaaggaagaggtaaaggtaggtgatgaaaattaatgcagggattataggagaagaccaggtctgggcaaagtggaggtttgagcaatcccactactggcattcatttccaaaggccatgaaatctgtatatctaaagggtatctgcactctcatgtttattgcagcactattcacaatagccaaaatatggaatcaacctaagtgctcatcaatggatgaatggataaagaacatgtggcatatgtatacaatggaatactattcagccataaaagaaaataaaatgttgtcatttacagcaacatgaatgagcctagaggatattgtgttaagtgagtaagtcaagcacagaaagagaaatacctcacgttcttgctcatatgtgggagctgaaaagttgaactcatagaagtagagtagaattgtggttattagaggctggaaatggtagcagggagaaaaggcgaggtagatgttggttaacagatacaaaattacagctacataggaggaatgaattcagtagttttgctgcactgaagggtggatacacaatagcttactgtatattttctcctttttgagatgggtcttactctgttgctaaggccgaagtgcaacagctattcacaagtgtgatcatagctcactatagctgcaaactcccgggcttaagtgttcctcctgtctcagcctcctgggtagctgggactcagcacgccaccacacccagctagtatatttcaaaaagttagaagacaggattttgaatatttcccacataaatgataaatatttgaaatgatagatataattaccctaatttgatcattacacatagtatacatgtatcaaaatctcactctgttgcataaatatgtacaatgattatgtatcaactaaaagttaaaggaaaaaaaagacaagctttgaaatcaaataatacaacaataacaaagttcaggtttggactgactgagcctaaagtatctgtgaggcatcttcctcccctgacaccctctgctaccacacagaccccgggagcacaggaggtatgcatggttcagaacagggcctggaagctcacacaggtccagtcagtatttgttgatggaggctgaattcataagcccatggactgtatgtatctggagagcagaagggtctggattagcagcagagatctgagaggcattcaagggaaagtcaaagggagagctctgggtgaatagaaaataaccagataggattcatcctttattgatgaaagtgctggatgacagttttatcatttcaacaacccaagctgagactttaagaaaaatatgaacttttgctctttgaaatggattaattggccatacaatataaccttgcaaaaacacagaaaataccccatcgagactaaaacatgtcaaggaaaaagacttttggagagctatagatgtaataatataattacaaatacttataataacaattatatactacatatttattacatttgttataatatcacatattatgttatattgtaaatatatttatagaaataaaactgggcaaaatgtctttggaaaatcaagtgcactagaaccacagcccaccatgagtactcaaaaatttaaaaactgtgtctaagtttaggcaggctgaggaggttgttaaggattcacaacagatctcaaaactttggatggcttctgtgcaaacacccatccaggtctgatggctgctgatacaatgacatgctccagtgtatggcacactatatagtgtccagggaagactgcaaagtatttctatacctatttttttaagtacagtgcattgtactacatacagaattaaatattgttaaattatgcaggaaaatcctttaggtacataatgccatttgattgtatcttttcgtttgtttgtttttgtttttgagatggagcttcgctcttgtcacccaagctgaagtgcaatggtgcaatcttggcccactgcaacctccacctcctgggttcaggcaattttcctgcctcagcctcccaagtggctgggactacaggcatgcaccattatgcccaggtaattttatatttttagtagagacagggtttcgccatgttgaccaggctgatctcgaactcctgacctcaggagatctgcctgcctcagcctcccaaaatgctgggattacaggcgtgtgccaccgcgcctgaccttgattgcatcttttaagctgcgatcggatgaccctgttacacaagatcttcatttattattaatcttacatctatttcctagcacctatataacataactgtcctgaatgccagcatgtcaccaacaagacaaagctcttgccattgggaaaatacaacctaaacaaaattattatcactgaggaagaaagaaaatattggtctagcaataagaatgttatccctcggcatttctcagggagttagtcaccagatgggaaatccagcccatggcgaactccttcttagtggtcattcaccccaagaatttccctgggactttgctctgtcatgtaattaatcacacactaggcctgcaatctgatgttcactttagctttatttacaagagtaagatcaaaggaaaaacaacaaaaaaagagagagacaaagatggggggaagggaggagaggaagtgggcagaaagaaggaaacagaaagaaagaaaacagaaagaaaagatgtcactataaagggccaacatctggggaaatgggcagacaaactatattacgttcacatgacagaaactatatggctgccaaaattttcttttcaaaaaacttaatatagggaaatccttctactaaatgttaaatttttaaaagcaaaatttaaagccatatctatcagataattgcaattttatttgaaaatatttatcatacagaaaatgactatagaagtgaaaatagtaattataacttggtaactgtacttgtggattattttattttcttctatgtgtcttcctgtatttatttattcatttttttgagatggagttttgcttttgttgcccaggctggagtgcaatggcacaatctcggctcactgcaacctccgcctcctgggttcaagcgattctcctgcctcagcctcccaagtagctgggactacaggcatgcgccaccatgcctggctaattttgtattttttagtacaaaattagacagagtttctccatgttggtcagcatagtctcgaactcccgacctcaggtgattgctcgcctcagcctcccaaagtgctgggattacaggcgtgagctaccgcgcccagctgtcttcctgtatttattatcctgtagtgctctccaaacaagcatgctttattttaaaaagtaaaataacaaatgctacatttaaaaaatacatctgattatcttttgtggtttttaaatacatgtaaagtactcaaccaagattaaaaagtgtgaggtgttggggctcagaaaccaatacaccaaaatatggggttttgacacatgctgaactgaagcaggcccctctgaccattcgccccacccccactgtctctcccaaattgtaggataaagttgttctctgaagtttccctttctgcctgtagtccagatcccccgaagaagaaaacaatgtcctccggttggtcccttccctgagttttcactaaccgtactcccgtcagaggaaagaagattaaagtctgtcaacaaacctggacagacttttgtcacaaaccattttctgctccgcgggcccaagaggctttgttcaaagccactgtatgttctgtgagcctgtggaatcctcccttgtcatcactgattacccctcagctgaaatcttcatttccctttcccataacctgttttgccaggatccaagcctccattctttctgtaacctcaagacattgtataagcttctgcaccccatgagggggtgagtcttcattctgaaggctctgtgtatacacattaaataaatgtgcctgccttttctccaattaacctgcttttgcaagttgatatttcagcaaacttacagaggaccaaggggaatccttggactttacaggtatttccttgatggacagcaaaaagataacttgagttattaatatataattcaaacatatgtcctaacgcatatgacatattctaattaggaatcactaacatatactttgtaaataggaaccatagaacccatgcgatttgacatagtgtgtctatttagagtctagtatatttcatcatctcagaatcgagcatgttaagacagaataacagtaatatcaccaaaaatgagttttagaaatataaatatcctcagcgctccccccctcaatattttattggtggtcttgttatttatagtgaactactatcatgtaacaaaagccaccaatgaaaaaggaatacatggatgttgttatcttctcaggaaaggttttcaggtaaggctggtgtctacactgcagttttatttcatgacctcctcatccctgtctgggtgagacagccccataggagctggtagacttgatggattatcgaggctgaatagaagggccggataatgcagctctgtgtgcttggtcaaagactccaggatcacagcttagaccctctttttctgctctctttttgtcatcctatctcccgtggcctccaaagtgtccccagcacctctagcttattccccagggacctccacgggccatgcacagaacagggcagaaatgctggtctgatgatggtgtgtttcccagtgccattccagagctgccagctttatctcgcaccctctctaaagcttcccccaatcccagaagcccacacacatgctttgtaaaagcgactgtctgcagctaggcacaccagggcgggaatggagcagtgggaacccctcctgtgttcacagctttctgcttggggactggctgctttggtattggccagaaattgcctagtcagagccaggccctgggaagaagtgctaggcagagacggccccgaccatcacggcatcagcaccattttcatctgctaatacaaggcatttaaaggctccagagaactcacctgcttcaagaagcttttccaggatcactctcaatggaggacctcgattcttgcccatttactgacttttatcaactctatggctctactctgacctggctagctcactcactccatctatcttcctagctacctacctatcatctatctacctatcatttatccaccctgtgacctttaacatttctgcttatgtttccaaatttatcactattgtaaaactatccagtggactcccaaaactatgaggcagtccttctcgaagggtggtccccggaccagcagtgtcagaattacctgggaacatgtcagaaatgcaaatgtccaggttccgccccagacctactaaattagaaaccctgagagggtttaaaaataagccacccaggtgatgctgattcgtgctcgggattcagagctatggccgcagggatttaacacccaccagtatccatttaaatatatatatataatcataagctcttttttaacagttggaaaattcatatcattatttttgctccttggactcttcttccacagatttttatcacaatgtaatacatttttcaggcttgagagtcttttgtttgttactctatcacacttctctggaataaagttgtatacagaaatattatcacttaaaaaaaatttctgtctataagatactaaatattaaacgttttttctagctgttatatattataatttatgaaacatcaaaattttcataaatcttattcaaataaaatattacaaattcatctcctaataagatgagtgagaatctctttattctcagtagttcacatatcctcggatgaagtaatcatcttgcttactgcacgaatgagctgggagtcagcatcatttctattcttatttaacactaaatgttgaaaaactgtgtttgcataaataagttgatgagaacagaagttttgttaaaatagttctttcccaattaattgaatcttttctaaactatacaaccaaaactgtatagtaatctagcattggaaattatttttaaaacctaaaaacgtgactagaatcctcttcaactttgttgaaagagaagaactagagcctgcttatgtggtaacagaatgttaccccgctattaaaagcgttcttgtaatttttgtaatttctggaatatatatgccccccaaatattgaccaagacttatcaaatgactttcctgaagatgtacctttcttaatatacacatttgggaaaatcaaatgttgtgatttgtattattgtgtagtgatttttaactagaatatccatgtctatgatgatggctgcactgtaaagcttctacttaagggaatggcattggcacagcccctaatacaggtcatggtccctggatatgtgcaatgtggtggccctaacatgcttttgccttatcagttacttaaaatatattttcattaaaattaagcacgcaactcagtttatggaaaataaccttcgtgttgtctaattagccaaatgaggaatcgttgtcagcccaatcaagtcagccttaatttctgtcagagggggggaaaaaagtgtgacttaattttgagttaaaagtgttgatacgtaccccttgaccaaccctcttgcttctgaatttgtaactggacacagacataaacaagcagaagatgcttgctgtgcattgccaaccacacgaaataaggggcaacagttttcatgctaaaaccttagcctcagttgtcctggggctcatcctcctgagcaaggcatcctttaccaacaatcaggacgtagaagagaggtcattaaaaacaaaacagagcaaagcaccctttccactacccactctgacatagatctgaacacagtccattcaaaaacaggacaaagcccttctttctaccaggcctcactcgacaaagtgtgcgtagcccggggagataaacgtgggcgtctctgcactgtcatgggttggatgatggtccccagaaagatatgtccaccgcctaatatgcaaagcctatgaatgtgagtttacttgcagatgtaattaagttaaagatctcaagatgaaatcatcctggattatgctgggggcccctcaatccggtcacatgtgtcctcataagagacattcagagggagacagatagacagggagcagaacacaaggccctgtgaagacagaggcaaagactgaagtgatgcagccttgggccaaggaatgcctggagcccccagaagccggaagaggcaaggatcccccatagaacctccacagggagtgtgaccccgctggcaccttcatttcggacttctggcctccagaactgtgagagtataagtttctgttgttctaagccaccaggcttgtggtactttgccttggcagccacaggacgcagacacaggcattcaggctgaaggaggcttgccaaagccagtcttcctcactgcatagcatctgctgcttctcagcttcttggaagatgccagatgagcatgcccttatttcatatcgtaaggaaaggtgattataaaaaggggattgagaaagcaaaactggcatgaagactgaagaagtgaagcaaaagcatcttctaaaatggccaggctggggctggccaggtggggcctgtgttccagttaaggacaggcggaacccttacatgcatgttacttggtaaaacaaactgagatgtttgatgctttctttgagatctgagtttctggttctataaataggaacttacatgaatttagacttaaaaagaaaaagtcccctagagtccttgtcccttaataatgaagcagagaatcaggtctgggcagatcagatcataatttccagaaggataaaacagggatgacatattctccaccccagacccctttgcactttgggttcaaattagtcatctcttctccagggtttggagtccatggagttccattctcagctgtcctctcatccccatgaagaggagccatgggcttggccttgtctctgggcttgtgtcctcatcgggctccgcagtctgcatctcatgctcactccagctccagtgatgatcaaagtttgtgtttctcccttggttcgtgtgaaaggacatctgcactctacgtgcttgtcagagcgcatctgcagctcagcaccaagccaggatcaccggctagtagttcagaggccaactatatacataggactgcctgagggatacagtgcacccttgctccagattggtacttctgaaaatggaaggccacacactttcagagcctggtgaaggaatggactttcaaccatgtgctacacaatcatatttttgtgttcaattttatggaggtacacagacgctcccccaacaaagtccattcctatgaatcccagtggttgtagatatcctcaaagttatccagaccatcaaaaagctgtacacctggtcagaaaatttatttccctgttaagatgttcatcccaaactgcactttagtctcctgccatctgcttccagtaaggactcctgaacaaaagtgctctgcccttcctcacttgctttgcagtagaactactgtgaatgatgttcatcctaatatagggcattgtcttcatgacataatgagaagaccttctcccagatctgcaggcctaaaagagccaggcctccttggataagcatttatgttggcagagtccatgactcagcatgatatcctttatgtgatgcggagctggatttgctgatctcctctttgtagataagcctcgtcctggccatatcttttttttccctcaaccctgatttcctcacttatttctttaaaaatttattcaccaaggaagatgacaatatctggggcacatgctgaaggcggctcatttggtttatctctctctatggagttttcctctctcttttcctcctgctcctctcctctcccatcagacacttccacccagccatttccaaaagaagagctttcaagggctactcctcatcactgcatgaacctctctgggcatgagcaaaacactccacagagattgacaggtgcagctgagatggctttctgccttcatcccccaaagtgaaaaacaaataggtattaatataaattctgatgaatatatagattgtacaatgcttattttaaaaatttggtctcttggccaggcgcggtgtctcatgcctgtaatcccaacactttgggaggccaaggtgggtggatcacttgaaatctggagttcaggaccagcctgaccaacatggtgaactaaaaatacaaaatttttagttctctactaaaaatacaaaattagccagacatggcggcacatgcctgtaatcccagctactcgggaagctgagggaggagaatcgcttgaacctgggaggaggtggttgcagtgagccaagaccacaccattacactccagcctgggcaataagagcaaaactccatctcaaaaaaaaaaaaaaaaaaaaaaaagagagagaaaaagaaagaaagaaaaataaatttggtctcttgcagacatttgcaaaagcttcctcaagtctgtttttttttttaaataaagaggcataataataataaacagacaaatacatttcttaaatttctattatctgtatcccttgtccagtaataataccatgatctctgtcttgatgctttctgtccccagagtaagactgccgactacgttgccttttaaaaaaataggtatatcacacagctgcagttaactgacgcttggtcagttagactggtttttatacagtgttggttgttacatagcagtttaaataatatggccagttgttatgctcaacaacaatttagaatgcaatacatttcaatagaattaaactggctattataacgcaataaccctcacctccaggtgtatcttcaaagaaattacaaaagtaaattgagaagaacgagctttttagtttttcccctgagagatatccaattttaacaaagctattactggtctagtgttatcacatggaaaactgattcttagtaattcacaaacgaaggtttgtaactaattaggtcccctttgccaaaattaagacacaaaccaattacaaaattgacacttttaagtgtagcatcaaaaatgtttgcagctgttggcaataagaaagcagacgacaaattgtaacaatgaaaaaaaacaaaatcaaacacattttaatgcatgaaaatgtggaggaagttaataagagatcaaagggaaatgattttccgtagttacaaatcaaacaagacataaaccaaaaatgacttattgtctttagcttaggagccaccaaatcagagccctgaaaaacatgtttttgtacacaaaaaagtaaaagaataagaaaatgggattttgttaccctacttacaaaacaaagattttcttaatttgggcttcaatcattttaataggtgccattttgtgtttgaagtatatttcctcctttcgtggcccatcaatctgtgagagaaaaatgtcaaaggaccattttctttctaatgagtttctatgtctgttcttaattgtagatctttcatgttaccttattttaaatctaccgtaactcatgatatattttgccaataacttatgtcagttataacataaacattgaggagtttggtatgaaaaaattaataactgttgaaacaattcctctcaatttctttttatcaaattgcttagttcaattttgatcattaatatcccatgggggtcattgcacagagttgcctctttctgtagaattcaccagtgttttaatttttatcattttatttcactattaaaggatttttctcaaatccatgatatcattcagtgttttattcttgagctctaggagtaggttaaacgatatgtaaaatcctttctccttccagttcatggtgctgattctagcattaaccacctgggtcaaatcccaagggcactgtttacctgctgtgggacttagggcggttacgcaccagtacatgacttctatctaaaaaggaaggaagaatgttactgatctcacagagcagattaaaacaattcaatcactcatgcctagtccatgggaagctcctaacaaaatcactgctatcattgctgttctgactataattagtaataacatgattactgtttttgtagttttagttgtcatcttgctgtagtcctgagaaagcctcaattcccttctcaataaaataatgttgaagattcagggaaactttaaaatttataatgaaacgaacaaaaaaatcttggatgaagtccaagttacatttctatttttggcctgtggaagaagtttgcaccaactctcggtagatggaactgggttgagataaatttaggtaaataaaggttggacgacctttgatgttccctacagaatccactagaaagggtgaggcaagatgggcctagatgctgcattttgaagatctgaagatggacaaacctttctctgatcatttaaaaagcggcttgggtgcactgggggtgggagtatggctgcatagagtccagagacccaaacttggagaattgccaggtctccacgactctacccctgaggatggcctctggaaggaaaaagaccacaaccaaacactgagaaagtactaggggacgtcatcttgagacctcagctagggtacatgcctcagtcagaaattaaccacggcaactggagcctgactctgaatggagcctgagaggcaggagaagaggcagccagaagccatgagaagcatggagggaaaggcttctggagaagtgaagagacgatacataaaatttgtttttaatgtgtgataaaaacattttataaagtgatgagctgcattagggtgggaaataaagtaaattatatggtggatgaattcaagtgtgctactggctgtgcagaagaaaagacaggcaagacagaaaataataacctaatgaataacctgtttggaaagtttcagattgtataacaaagccagagggagagtaaaacatttgcagtttctcctatgacccggtagagtcaatattcaaaaaaaaattttagtattacctttaaaaataagaggttaaacaatttttgaaaaaacttaaaactgataaaatatttgacatgaccactggctcaaaatgaaatcaaaaccatagttataaggtataaatatattaaacatgagatctgatgcggtagctcacgcctgtaatcccagcactttgggagcctgaggggggcagatcatttgaggtcaggagttcaagaccagcctgatcaacatggtgaaaccctatctctactaaaaatacaaaaaaattagccaggcgtggtggcacgtgcctgtaatctcagctacttgggaggttgaggcaggagaatcgcttgaacccagaaggcacaggttgcagtgagctgagatcatgacactgcactctagcctgggtgacagagcgagatgccatctcaaaaaataaaataaaataaataatagagtaaaataaaaataaaaatagaatataaaaaattaaagcatatagccaagtatgtaatcagagggacattcatgctttaaatgctttcattacagatgagatgaaacaaagtgaactaaacaaactactaaagaaattcgcaaggccgggtgtggtggctcatgactgtaatcccagcactctgggaggcctaggcaggcggatcacctgaggttgggagtttgagaccagactgaccaacatggagaaaccctgtctctactaataatacaaaattagccagccgtggtggcacatgcctgtaatcccagctacttgggaggctgaggcaggagaattgcttgaacctgggaggtggaggttgctgtgaggctagatcacgccattgcactccaacctgggcaacatgactgaaactccgtctcaaaaaaaataaaaaaagaaggaagaaattcacaaaaggcactgcacaggaaggaggacgaggagaaggagaaaggaaagaaggaagagaaggagagaaagaaataacacaattgcaagggaagccttttaatttgaactaaatctgaaagacaccttttttgtttaaaaaaaaagacaacctcttgaaacaaaaaaagacaaacaaaaattttaaaaatcaggaaaaagaaaaaaggaaattgtcctcaaaaatacaaaattttgttcacgttcaaaatactgcatctgatatctaggctttagaggtagatcattttatagatgagttctttgaacctccaaagaaagaattagttcatataatagataaattattcagggcattaaaaaaaatagaaccaagttacccagttcattttatcaagctagtaaaggcacattaggccaaagagtgacaaatacaacacagaataaattaaagttcaagtccaatttcacttggaaatacagatgttgaacacaattcaactattcatgaaaaaataatctgccccataaagaattattgatcctattaatgcaagactagtttagtatgagaagatagatatttttgtatgtttagagatccaatatgaaaaactaagaatccttctatttgccaaaaaatgttcaaagaatttcaaaactatttgctatattttaaaagtgcaataacaaatagaatactttatagacatcattttacaaatctcacaccagcagctattatgcttaattttaaaatgttaaagacattctggttaaaatcaggaataaaataatcattgttattattttatataattctagtttacacagtaagatgtggaaataaagaaaaaaatcactaagaaggttaagatcaaagttattagcaactgcagaaaaaaaaaagattttaaaatccaggaaaattatttaaaaaatttctgagcattaggaagaaaattcaataaagcaacaagaagaaaacatcagtctctacctcaccaatataaaaaatccttaacaggtggggatattttcacaaacattagtaatataaagcactaaggaataaattcattttttaaaaaaccattttattatgaaaaataaggaacaaaaggctatgttctcagactggaacctgttgaatattttaatatgtccattttcctcagtgaatatgtagttctaatggaattctaatctaaaccccaatgtattttttcctggaacttcaaaaatatgactcaaaaaccaaaagaatgagattgtacaaatggcttaggtattttgtattaatagttttcaagtggattatttatgtttgatcactacagcagtatcataaaataactcgcgtgacattctcaaatgttgtcaacatgatgtcaaagttggcatcccaaaattcctgagcgatatttttcaatggttgtacagaaagcatctttctgttaaagttgtcgtgttttatcttgtttttaacaaagctgagacaaattttcccactgactttcactcacagttcaaaaatgtgctcttacaggaaaacctaaaagaggggaagggaaatagcctccagacacataaacacacccgagaagtcagatgaattctatttaacaacaacaaacaaattcctaagtattatactctataaaggcagagtgtcctggaaatgccatctggtgccgtgcaatctggattcctgtgagtgccagggacaagtggctgaaccgcaatgagatacggccaaacaccagaaacttcacgaaagaatattatcttgtaaatgtgttcagagaaaataattttgtccatgctgtttctgtgtgtgtgttttagattaatctttcccaatattttatacagcatataaagcatatagcgtatcaagtatataaagtatatatattgaaaatggagtggcatcctgtttctgtttttacaataaaggagacacttcttgagaactaagctcaaaacagttcctggctcactcagagtccttagtacttaactgtaggaatttcaaaatgatgaatgtcagatggtacaatacagaagaatagaggtaaattgtgaagtcagagagaatgaatccagatgcaagaacatcaattcgttctcacagttgcctgcaaactatggactaaacacaatgattagaatatctatttcatgtaaacatgctaaataatcgaacatgtaagttcaatcagagatgcaattaactctgcacaccaaaaatcaaagtgatgaagctgagcattcgcgaattgaatcagttcccttcgacgctttcatgctcccattaatatgtagctgatgccactttctgacttcgaaggacgatttattcttctgaggatgatttatatgagttgaaatgatacacttctattttattacttgtgcctactgaccttgagccactaccaagtcacagagattcacatcaaaagccaaagtcagattctgtcaccaaaactcatggtctcagggattctgtgattttttttttctggcatctaaactctgtctataaacacactgtccttgtggactgtaattactcatagaaggaccaagtgctgcttttatgaagtctctgatgtttgccatatctctggacagtcgtgataggaacctgatgagttgaaagctgactgtccgtcagccaccttgcctttcttctttctacaagcctatattattttaattgcagtatgctgctgctgattcttaactactttgccctctacaaagacattattagctaaagccctgtagcatctttgaagtaatgattcatttttttcttaaatcaacataaagttagcggactccctggggcattctcagcccaaggaagaatcacaagtatgcatccctgacaaaaaagaagcaagtctgttttttcccaaagttcttcagaaaaaaagtatcccataatttatcaggtaatgcattccagtgtctttattaactcaaaaaaaaaatctggtgtttaaccttatgccaatgtgtgaaaaacagaacttcactataccttacacaaacaaagctaatccatagaatcctgaacacaatgaggcatttcctcatccattccaccactgtcttttcatcaggattctgagtaagttgattttttaaaaatgaccctgattcagtatccagcttagggttcctaacattgaaatggaatcattcatcaaggtcacaattatgaaataatgaggtttccagactagaatctatgtgtttacctagtttcgttataggcccaatttaacaagtaatacgaattgtgatcttaggtaatgtagacttctattacagaccagccatagattcacggaaaatatacatgctaccctggaggtgcccttcactatccttgcacccattttctattttccacccatgcaccccattttccacccatgcacttggccaggaagcagcagaaaagagagattaggaaggcctttctcaggaactcaaatctatatcgcatgatcactcaggagcgttgggatataatgcgcttgcttgctaggacacccgtaacaaagtaccacagatggagtggcttaaattacagcattttgtttgatcacagtcctggaggctagaaacccaagatcaaggtgtcagcaggatcagttttctctgttttctctgtggactctctccttggcctgtagatgaccgtcttctctctgtcttcatgtggcttctttctgtgcatgtctctgtcctcatctcctcttcttatcaggatgccggtcatgttagatttaagacccatcctaataacctcattcttaactgaattacctctttaaagaccctgtttccaaatacagtcacattctgaggttatgggagttaggactgcaacatatcaattgtgtgcaagtgaagtgtggggacacaatttagttcatagcatagagaaagcatcagcattgcagcaacatttctcaaaaaaatgatggagttgttcaacactcctgacacaggtgaaccccgctggcaaattagtttctcaaaagcggaagtgggcagaacaaattatatttccttatgtgtgtgtgtggagaaggggagacaagggattcaagctgaacaagattattatttcattagcaacatggcagacacgcagacacacacacacacacacacacacacacacacacacacacacacacacacacagtcttataatcatattcatctgtttcttcccggacccctccttccaatgaaattccttctctttacccatctggcaacaagatgaatggcagcttttctagctctaggttgagtaactttcagttactgcagggagcaaactgcctttctgacaagaagaatgaaatatgaaagggtgacattgggtgtttcaaaactcctcctcagtatcttacagatattgcacgtgcttataacctggtacaatgacaaaggaaaaaaatgcctgtttctctgggaagcaagaaccaccatcaatagactgacatgaactaaaggaaatctaaatgctagaaatgatcaatgatgattagacaaatactaattttaaagcatatctatgtgtattgactgcaaatacttttgtaaagttattccttcgtatattgaacaattttctccagttcttatcataacagtttttcacatgttctatatagtttataagataactaaacttttcccaaatcaagtttacacaccaaaattatagttcctcttctttcttgcagtcatattgttaccatttataaccaaaattttgcaaaaagtgaagagaatccttttttttagaatgaacaatttcttaatttaatataaagtttctgttagagtgagattaatgtgatgtacaggggcaaaactgcccaaaaggtcattttatgtagataacaaaacagaagttagatttcccatcttcagaaacatttaggacgatgttgagcatgaaatccactcctagagctgtatgttttaggttctctcatttctccaagtcagtcagtttaaaggctctattcttcttgtttcccttaaaccttggaatactcttccaaataaaaatctatcaaagacctgtccaataagtgccaaatacttctaacaattttgcatgtgtgggtgtaaaacaaggcatttattcattaactatgtatttattaaactcttactcttctagtgctaagtcactgctcctgaaccagggaaaattttgcaacccgccctcaggacatttgtgatgtctgcagacattttcattatcacactggttgggggagagggttgcaactggcatctaggtaaagaccagagatgctgctaaacatcctaaaatgcacaggacagcccctccaccaaagaaatatctggtccaaactgccgttggtgccgagggggaaaatctatgtagatccttgaaaataaaaagaaagtcatagataaagactggaaatgattagaaacccacccggctgagcctggcctaaattgtcaagcagaaactatgagttaaatagttactgtttcaagcaaatacgtttgaggttgacgtgtttcacagaaatagttaagtgatacaaattgttaattgaaacaatgggcctgaatgagagcacccaaaatgatcttgtcaaaccagaagacataagggcagaaggatagaaggatggaatgctgacgagaggcaggtttcagaggactggtggagagaaagagaggagccagcaaaagtaagggcattgggggtgggggtgtcagatggagggagaaagaaaacaaggaagacagaggtaagagagtcagcatgaacagttacaggaaaggaggggaaggcaatcagatgaaagggagaggccagaaagagaaaaagtattaataggaatatcctgttaaacaatacctctttaacttcacaccttaaagaaaaaacaaagctagattccaggaatttgtttttaggcacagggaccacagttgggctgacactttactggcctcctgaaagaatgaacagataattgagattctggtcagtgcccataataccagaattaagggcaaatccctctgccaacagctggagaactgtcctcactgggcagtgaagacatctcatgtgtagccaccaagatttcatcatggccatggcttgtcactgtcaggagcactttcaggtatgatactgttaggtggggctatagatttgaaaacttgtcaaaccaacatcctccaaacagaaggctgaattaaaaacaataactaagtctataatactgatgggtgctttaggcaatgaagctcatctgacaggtccagcaggcatttgatagaaggggagttgttccagggagcctgtactctgtagagcgtcatgagggcacccactggtggaaggagcaacagggccacatggagagaagagggggactgtacctgcacaggggctccaacaacatatacacaaagcacccctgatcagcaggagtgacaggaatgaggtagaccaatccccggtaagctatgaggaccagcctttgagtggaacttaaatggccaccaagaaaccatgtgaccttcctcagaacatgaaagaacaaagtcttggggaaccttggcattcctgtcactctccatgtgaagatttggaagcttgcttacattgcatctgtgcctacaactgtcctaggtcagttggagtggataaggaggcaggactggatgtcagaaggagattttattcatagtcttcaaaggtaaagcatagctgctcttttaactactagactaaatgcatactcatagaacacctaatatcctaagtccaagattttatttaggagtgagagattcaactttgcagtaatagaaactgattccaaagtggtcaaagtcataaagctgatttgtagtaaaatcacacaaaatattaatttgccctggatccctagtctagaaaatttttgactgcactatgttgcacttaaacaggaaatattaattggcactctgataggtgaataaattcagggacaagaactgaggtgcagcgattcccctatcactagacagagctaggatgaaattcaaatccagatcataagtgttggaccccatgagcttaagagtaccttaatttttgttttatgttatgttcttctcaattttctgcattaccatttcttccctcaaaaagttacacctcccccagagtatcttctttttttattgacccatgttctttatctactttctgcagcaacagctccactgagaaaaaaaaaaaatcagatattacaaatctaatttagtaacatgaaatagttcccatgagctgcaagctggctgctcgtgagctgtggtgagatttaagtatttaaatgtatacggttaataccctcaaagcacagcaaaaggcagttcacgatgaagaaaccaaatgaagtcatcctaaaattgcagattttttaagaagcagaaacatacagatttcaaaaaggataaggaaaaataatggacagatgacatgaaaaattagttcacacacaaaaaagtggtagacaagtggccaactaatatacaactgaggttcatactaacttataacagaatgcaaataaaactctagtttctcattcttactatcagattgctaaagattaagaattttaataacactcaaggatgataagagagttggaaaacagacattttcatatattcttaataggaatgtaaattggtgcaaacttcttgaaggaaaatttggaagtaactatcagaatgcaaaatgcacatgccctgcggtgttaccagtttacttctagcaatctatccaacaggtgtaggtgcacaaatgagcttacaagtttattcattgcaggattatttgtaatagcagaaaactaagcacaagctaagcactcattagtggctaattggttgttcttcttcaatgggaaaaaaaccatacaatcattctgtttttaattgaaataaatgtatacgtggtcttaggctgaaacttcacactagaattaccgcaaaaaaaaaatcccacaacaattcagaaaattgcgtgcaagacatgcatgcatgtgtataaagaggcttctctgtgcatggaccattaatagaccaacaccagaaaactattcagagtggctacccctggctagaagttctaggggaggtgtgagtagaaatggaagatgatctttaatttttatactatgctcctttgtcatctttaagttatatcttgtgagcatgcatgtattgctttcctaataactaagctatttaatgaaaagaagtcacactgcttcagataagtaaactaaaattaaaattcagttctgattgactgtatcaattctaagtgtcattttggccaatttagtcctgaacccaggggattttagagtcgccaactttgctggtgtgtctgggattgaagggtttctgggatataaggcttttagtgctggccaagcacggtggttcacgcctgtaatcgcagcactttggaaggctgaggtgggcagaacaactgagatcaggagctcaagaccagcctggccaatatggtgaaacaccatctctactaaaaatacaaaaaattagccgggcatcgtggtgcatgtcggtaatcccagctactcgggaggctgaggcaggagagaattgcttgaacctgggaggtagaggttgcagtgagccaagatcatgccattgcactccagcctgggagacaagagtgaaactccatccccccccaaaaaaagacttttagtgctaaaactaaagcagttcagagaccagcaggtcaccttactgggcttggtgagaggaagggacctgggtgagtgaggttcctctacaaagaccaaattccccttaggtggatccaacagatcaaatggaagaagctagaagtccctttggccctcatacctaaatcacattctccaaaataagttcttttagaaataaatacaatgttctgatctccatcagaactgagggacagaagatgggttttattttaggagacttcctcaaacccacaacaaataattatatacctgctactacaaactagcaccatttcttatggtgacaattcaaatgtcctcaccccacttttcaggagtgttgaggctatcttgggccagtggggaagggaggaagtagagccctggccatactcagaaccaggggaactggcctggcctgcgaagccacaacccaaacacctgtgaccaaaccaggcctctcaggccaagatatacacaagtaggaactgtccagtgggtagacggggtcttccgagcaattcccagactctcagaggccacagcgtcattcatggttccaggtgctctgtcctattctgagcaaaactcaaaagcactggtggggaccaggctagtgagagttagacaaaatgtccatgctccaggaaacaatgaaaggttttagggaaatcatctttctcattaagggagacaaaacatcagaaaccaaagaagttgagttgtacagacatgaaaaccctgctgtatctgagtagatgagagggtaggagggagaaaggcaggcagaataatggagctcagaggatatttgagtgctcagaactcatcccatgctacccgacggagagcagagaggaaggcttggtccactccctgggtgctgctggggagggagctgcaggcatggcaaggcctgtcttaagcaggtggtagaattttcagcctccactcccccgacagggcagggctggagaaagctggccctgatattaaaggagtattttgaagtattaaatgatgcggtttttttaaaaaatatttttcttccctttatttctctctatcccaaagcgtcccctgcacacacacatatttattagttactcagcttactcttgcctcaggatagagatgagatgcagtgaaggacagaaaaatcctaagctctttaaggttcttatttctaacagcagtcactgccccagagccaagagaggatcttaggcagagacaaaatacccaaaacctcaacaggagatggatttttctgaaggctcgggaaggattccctcaggctggtggtggagctgggagaagaatgagaaggcaggaagatgggaacaaagagatccatgagtcctgcagactcccaactccccagcacacctccaaccccaggatgacatggcagaccctcaggagggaacaaaggcaggctacgcccatcctcatcatccaggactctcaatggcccatcagacatttccatccccaagtcatcttaaaagaccagagaactatttgacctgaagaaaacacacagccagagcaaagtgctgatgttgggagttcaagaccagcctggccaacatggggaaaccccgtctctagtgaaattacaaaaattagccgggcgtggtggtgtgtgcctgtagtcccagctactcggtagggtgaagcaagagaatcgcttgaacccgggaagcagaggttgcagtgagctgacatcgcaccactgcactctagcctgggcgacagagtgagactctgtctcatacaaaacaaaacaacacaaaacaaaaaggcacttttgcagctctcggtgcaagccctcccccaagcttttgttctgtgtaacctcatggaaccctagcacaactcagggagggaggtggtgcgaaataactgaggctaactactgtgcaggagctgcaaagaccctgcagatgcccctgtgtcactcactggctagaacaacactttgctcacagcctctccctgcaaacacatgccactctctgcctggagcttcttctcaccagagtttctggatgagctgactcatgggtctcagtgtgaagctttatctctagcgtttaatgaaagtgaggagacagaaaggactcaactatgaatattctgtctttacggcgcaagctcctggccgcatagatcagcatttgaaggcagccgaggaaaatgaaacaaacttcaaagtccaaagaggaaaaaaagaagggcccgtagaatattcttcaaatgaaattaactgaccaccagatgctctgaggttttcaggctactcagcttaaatcagagggagcgtatcctagcgatggcaggccctgttcggccacagactgtcactttcttttggttctcaagtaagaatccttgaggtgctgtgccgcagagcagattcaattttgttcacttaattttcatctctcctacatggttttcttctacaaaaacggagataccattttcttcaagggccatttaccatataaagaaatacatataaagggagtaaaagaaaattaatataatcatgtcataaggcaatggatttttgtctctccttttacacagtctgacttttgcatacattgattaaaagctccaccagcgtctgtcacatactatttatatggaagctttatcacaaaacagaaacaaatggtctctttttttttttcttttcagtcctcatgactgctacctgggtttacgccctcttcctttcatagtttttatctcacccagcattcaatcattaaatcttggggtttggagataaggcctttctctctcctgtgtatgtcagaaatgctttccggagaaagtcatggaatgcccaacctgtgctgacttaaactctcgacatttattgctatgtaacaaaaagttctagggttgattggtggctcagcagtatctccaaacacccaggctctgtctgttccccaactcagccacatcaagcataataatttcttacctcactgtcacaaaatagctgccacagctccaggcaccatgctcccacacagttatattcaaaagcaagaaactcacgaagaaaccagggaagtgagagtgcctttatcctttagctctttcttccatggagggagagcattaggacaaatatctaatgcatgtggggcttaaaacccagatgatgggttgatgggtgcagcaaaccaccatggcacatgtatacctacataacaaacctgcacattccgcacatgtatcctagaacttaaagtagaaaaaaaaaaaaaaaagaaaagaaaaccctttccagaaataccttccacagactcactcattggctagaagtgggtcattgtttcaattatagggcctcgctgatttttaagtaactgccagttcagtttctttctcttctttctaattgctgcattccccaaatcatcattctactgaaccaatatcctcctaaaaggtccctgcctcaaatctaccctccataccaatgctactccagtactcagtaaggtggccagtcttcaagaagcccccatgactcctgcctccttgcatttatacccttatgaagtcccctcccactggttgggtgtggccaaaagaacatggcagaagtggtgggattttgtttctgaggttagatgataaaagacactgtggcttccgtcttggtctctctcatcccttctctgaggacagccactgccacattttgaggatactcagccactctctggagagatccacagagcaaagatggatgcctcttgccaacagctgcacaagtgatcttggaggtgaatccccacccaagtcaagccctcagctaacattgtgactaacacctcatgagaagctcgaagctggaaacacccagctaatctgctccctaattccttacccatagaaaatgtgagataataagtgtttgttattttaagtcactaaatttgggggtgatttattatgcagtgatagataatgaattcacttactgtgaaactgtcttggttaaaacccataaatggtctctaccacttacagcagaggacctggcattgccagtaggtgagttttggtccacggagtcttttgaaatattttgaactgatgtttcaaaattgggagatgttaaatagacatcataacatcttgccaaccaggtccacatttccacagaacacccaaggccttggccagaggattggctgtctcctttacaaagagcatgccttccaactaccaaaggcctgggccaaaggattgcctgtcttctttatgagagcatgcactccaactcactgagaggattggctgtctcctttacaaagagtatgctctccaacttatcgagtgccctccactcacccaaggcctgggccagaggattggctgtctcctttacaaagagtatgctctccaattcattgagtgccctccactctaattcccccaatagtagtgaggacatgtcatagttgccactttttgatccctgcatgaaccattactttagttatgtctgagacatagttttgtgaacctttgcccctaccaaaaatgggcaaacaaaagatagactgaaatatctctagtaaataaaaagctagaaaaggtttccgcacacctaaggaaacagtcaacagagaaagaaggtaacctatagaatgggagaaaatatttgcaaatcatacatctgataagaggctaatatctaaaatatataaggaactcaattcaatagccaaaaacaaaacaaaaacaatccacaaatgacctgattaaaaaatttgcaatggattgcaataaatattcctccaaagaatacatacaaatggccaataagtatatgaaaagatgctcaacatcattaattattaaggcaatgcaaatcaaaaccacaatgagatagcaccccacacctgttaggatggtcattatatatatatgcatacacacacacacacatatatatataaccagattatatatattatatatataatatattatatataatatataattatatttatatataatttatgatatatatttatatatatttaaaaaacagaaaataagtgtcagaatgcggagaatagaaacccttgtgcattgttgatgggaatgtaaaatgtaaaatgatgcagcctctatgaaaaacactatggagatcatcaaaaaattcaaaatagaatgaccaagcggaatccagcaatcccacttctgagtatttatctaaaagaactgaaatcaggatctcaaagagatacctgcactcccatgttcaccgcagcattattcacaataaccaagaggtggaaacaactgaaatgtccattgatgggtgagtggataaagaaaatacagtatatccatacaatggaatattattcagccttacaaagaactgaatcctgtaatatgctacaacacagatgaacttcgaggacattttactaaacgaaataagtcatcacagaaggacaaatactgcatgatttcagttatatgaggtatctaaagtagtcaaactcacagaagcacagagtagaatggtggatgccaggggctggtgggaggtggaaacggggaggtgttcgataggtctagagtttcagtcacgcaagagaaaaagttccagagatctgctgcacaacagtgtgcttatagtttacaatactatattgtatacttaagaatttgataagagaacagacttcatgttgtatttatttatttatttattttctgaaatggagtctcactctgtggcccaggctggagcgcagtggtgcaatctcgctgcaaactctacctcccaggttttagagattctcccacctcagcctcctgagtagctgggattacaggcacctgctaccacacctggctaattttttgtatttttttagtagagttggggtttcgtcatgttggccaggctggtctcgaactcctgacctcaggcgatgcacccacctcggcctcctgaagtgctgggattacaggcatgagccactgtgcccagccttatgttcaacgttttttttttttcaccacaacaaaagagagaaagagagaaggaaggaaggaagggagggagggagggagggagggagggagggaatagaaagtggggtaacatctttctttgttagagaatattttcatcttttaacatgtaaacaaagtgtctaacaactataagcaggtctcagttcactcatttatcttacctgcctggtccctttaggcatcagtgtttattatcccaggtctacagggcagtggtgcttcataggcacagtccaggttctctggaatccagcccagaccaccaattcttgctgtcttaccactttgtgacatgtctcccactgtgatggttcacattatatgctgacttggctggggtatggtgcccagtagtttggtcaaacaccagtctagatgttgctgtgaaggtaatttttagatgtgattaacatttaaattggtggaatttactaaagcagattatcttccatcttgtaggtgggactcatctaatcagttgacagtcttaagagcgaagattgaggcttctatagacgaaggaattcagcctcaaaactgcaatacagaaagcctgcctgagtttccagcttgcctggcctgccatgtggaattcagactccagactacaacaccaactcatacctgaatttccagcctgctggcttgtccaacagattttgttcagcacgcacatcatgtgagtcaactctttaaagtaaataaatgtgtctagcacgtgcgctgtctctctctctccttcctccatttattacacacatacagatgggtgtgtgtatgtatgaaaggaatgtgggagggtgggtatattagttagggttctccaaagatgtggaacaaagatacagaacaagtgggaaagacagatctttctgtatctttggagaaccctaactaatatacccaccctcccaccttcctcacaccaccaccttctatcctccatgtccttggtcatgcacttggccctggtcatgccacccccttccaccaggacatcttgccctcccatccccccagcaatgcattctcctttaactcagtccaactgtcaccttgcccaggaagctccccgtgaccacgcagactgggatatatttttctccccgatgacgctcgtttgtgcagatccctctcaacccacacattaagttggaacatgacaacttcctttatgtggcccaccagaagaggaaccgtgtcttattctgtcaaatgaatgaataaataaacggatgaatcccaacgtgttattactgaggaggacaaacataataatcttagacaaaagtagttttacagaattaccatgtaaatcaccatagaatagaataaatgctttgtaatttagggggaaacagaaggattttctgggcttctggcaaagctttttcctaactaaatcatttcaggcacagcttttgcaaatgcgtcttctgctggtcataattatgcgactcccaccccccactgctttgaattactttgtgctaacaccaaaattgttccacagagagtaggatttatttgctgaaatgtgatgaggagaagtgggataagagacatacttcacatgcggtgcctgttgctagcacagctgtatttctgagaaatatatttcagtcttttggctccatttcttttgtagtttaataactgaagtacaaagctcatgaaagctgggaatgtgttggaaggtcagtgaggaaaaatgcacgtggtgcagttaggagagacaagggagttaaaataacaggagaaattgatcacttacgatctttctggttggtggtttatggctaaatgtctgtttcagctaaagaccaaacactggctcacagctacaaagaaagtagaacaattaaaaaactcagcaaggagaattccttttgtacctctattataagcatattgtttatttaaaattattttatgtaatgccaatagagtaatatcttcatgtcattatataaatgtaatggcagtggctagttttgccattggatgacagtcctacacactggaacacattttctcacctagcagaaagccttgcctgcagcactcaccaaatgcctcctacagtatcttcctcatgtgcacaaatggctttatgtcagaaatcaacatccactgagacaccagaaatttgaacaggtccctaaagacaggttgactgcttttcctccctgtggcacagtcatttgcagtctttacttggtattgcatctgtaaatgggatgtagataatatcgccatcatttccagggaatatagtgttatccacatcagcgttcatgataacaaacacaatgtcccagctgaactttgtaatcagtacttttgggagaaccaagtctgttttagtttaacagatgcatctgatgttgttatctaaccatctgaggctgtgatgaagcacagaacgcaggctttgtcatcagccagtgctacaccatatccagggccggcttcaccagatgtgtgatcttgggcaagatgttttgcctctctgacctgcagtactctgctctgtaaaggaggtccataaaattctctttggaggatcaatatgaaaatcagaaacaataaattaaactatctggaatagggattggcacataagagatgacaaaaaacaaaagaaagtgtttgtaatagaatatggctgacactattcctgctggttcgggattctggctgaagctttaaattgagaatggaagaaaagcctttcatgttccaaaggaaagtgctgaacacatttcccagcacttctgaaagatcgaagagccaatctagaaacagaactctgtgtctagcatgatacatgcaatatgtgtgcaacatgcaacttgcatgtatatacacctatattatgtgtgcatatgtacatacagtatctatatacacacctacacatatgtaaataaagctcattaaacaggatgtgccaatttgtcagccaatggggaattgatgtggattctccctccatcatgagagagggaactagggtgctcgtccactctttcaagctaaggaaaggggactccaggaagatatgtcaaaagaaactacacacacttcaagagggagagattggcaccttgctccccagcacagccagtgcactacagactgaacaaagtgtaaagggagctcctgaaagaactaaacgtgtgtgtgtgtctaggaatttggggcatatggaagcagagactgctgcctctcctattctgaataattctgaagatgggaaactggcaggagcagtgcaccataaaagccagggaccgaggatgcacttggggatgctacagcaggtggttgaacctcacagtttgaaagcacccacccaattgggcagcctgctggactgagggctcccagcaccaggaggctgtgggtatgaggccattggaagcaacaacagaggagaactgcaaaaggccctccatacagcttattgatttatttggagaggcttctgcggggccactaggcaaccacaaaggtgctcccaagggagtgccagctttggggaccagccacatgcataggggacaggacaggtgggtttcaacagcctcatgtacaggagacttgtcctctttcctccagtctgttttcccccaacccctgccctagagaggtgaggagaaggaaggagaccccaagccagggaacagaagagctttgaactggatgggagactgaagctttccctctacctagattgttaatacctgacagtgaatctcctcttacaaactgagccagagcatcaagaaggctatgaacgaatctccctgagatgccttcagtgagcagggaagggaaagccaacagagcaagattgaaatataagtgggagaaaagtaaagccatttcctgtttatatacttcagccttcagaggccacaaaaaaccagctacatacgattatgttatttcggagcctccaaatggagtgacacatactcttttactgccaattaccaaggcgtggaaggtggagagaggactctctagctcctctgctccatctctttgtggctatcacattggcttcaatacaatgtgacttaggtacccaaattattctagtattgagacaggcaagtgtaaagaggtccctggagaaacttcaaccagcctggtcactgggaggaatgtgcgctggggaggagcctcgggaagtctgtgccattttgcagcagggaggagcctggcctctcttgttctggggtggggaaactgggattcaatctgtgaggcaggaagccagctagcaggactctggttttgctgagagtccctgtttcccttttttcccttttcacccaataaaccctgcttttctcacccttcaaagtgtctctgagcctaatttttcatggttgtgtgacaaggaccctgcttttagctaactaaggagaaagtcctacaacaatatagtgggacaaaacccagagacaacaatcgatttcagccaatccagattctaccaagtctgtaaacagtacatatattatatatatatatatatatgcttacagttacttccaaacctctttttctcataatcacccaaacctagactaatgagttcccccatttctgctctcaaaatttctccaaacaagcccttttctctaggggtacagaattcctcataagctgaatttgtaccttctctttgtactgtaatctatgatcatgcataagtctttctctgaaggggaaaaaatgacaacttttgacttgaaatccagctctggatttacctagaagtcaagcttgttaaaatatggtcctcagggtttagaagacgagggtgagctaattctgagtctcagcctgcctaccaaaccagccatacgatcgatacggaagacagataaaaccacacaggactcatgccttcagcatgaccagacaacagagaacactgcaaccttcaaattgcctgaaagtaacaaattccaacagaactctcaccacctactcatagctgctaagagcctgtggatgcagagagcagagagggaagcagaaaagagctaagaaaataaacagagggagcagagggccacgaggaagcacaaactcaccctagaaagaggaaatgaaatagacaatgcaaaacaacccaataccagtcaggacttggagatgcataggaaggcactggagagtgggtggggccagaaggggtggcctcagaacatactacttgtgggggataatcagatctaaagaaaagatctgatgttccttggagatgagacagagacgggaaagaaggacttaagaagggggaataaggagcctgcagaaacacaacagtaaactagaataagtggagagaccccttgctcttgatttggaggtctcggtgttatcaagatgtcagttctccctaatttataaatgtagtgcaagaccaacaaaaattctaaggagctttttaatggagacagacacattagaaaacaacacacaagaatatctaggaacacatcaaaaaggaataacttggtgggggtgagaaagggataataccgctaccagatgttaaaacataatatagacttcccacaattaaaacagagtggcactggcacatgaatagactgacatcaaagaaacaataaaatgtcaaggaaaagatgaaaaaaaagaatttccatttggaaaaacataaaagtagatccatccgtcaaaccctacataagaatgaactctgaatgaatcagaaatgtaaatgtaaaaataaaaggacatatactagaaaaaaataaattcttctacaacctatgtatatagtaaaaggctaggtctgacttaaaatttaaatgcaataaaatactaatatgtttgtttgcataaattaaaattttaaaaaaggttgtatggaataactacaccattagtaaatttctttttattttattttttattttagatggagtctcactctgttgccacgctggagtgcagtggcttgatctcggctcactgcaacctctgcctcccgggttcaagcaattctcctgcctaagcttcctgagtagctgggaccacaggcacacgccaccatgcccagcaatttttttttttttttttgtatttttagtagagacggtgtttcgccgtgttggccaggatcgtcttgatctcctgaccttgtgatctgcccaccttggcctcccaaagtgttgggattacaggcgtgagccactgcgcccagccaccataagtaaatttttaaatgacaaaatggaagaaaaatttgcaacatacattgcaaatagaagaattaatgtcactaatgtacaaggcactttgcaaaatcaaggatcaaaaaccaaaagtcctacagaaaaatgggcaaacacatgaaaaactattcattaaaagaaacagatacatggcctagaaccatatgaaaagatgctcaattttgtttataataaaagtgcaccaagaggctgggtgcagtggctcacacctgtaatcccaacactttgagaggcaaagacaggaagactgcttgaggccaggagtttaagaccagcctgagcaacacagacaccctcatctctacaaaacaaaacaaaacaaaacaaatcaaatcaggcagttagtggaaaaggaggcaacatttttgaccaggtggtcaaaattacaccacccatgtgaaggacatagtatgtgcttccagaagggatgacagaggacacagtatcttctatgcagtgggatggccgataacacacctcaacccaatcacaaggaagcttcagtcaagcataaaatagggagcattctgtttaaaaagtgaaggggctactgtattaaaaaaaaaaatcaatgtcttaaaaggcaaagaaaaatcatggaattgttctagattaaagtaggctaaagagtcatgacaactaaatgccatgcccaattctgaactgaaccctgtactggagaaaaagtgttacaaaggatattaattattatgttaactgacaaaattagaatatgggcagtggattagttaaaggtattgcatcaatgtgtgtgtaaatcaatagtgtaacatcattagtgtatgtggttatattaataaaagatatttttctacttttaggaaatacacactgaagtatttagtaggaaggaccatgatacacataacttatctgcaaatgattcgaaaaaaattgtgtatgtgtgtgtgtgtacacagagaaagagagagagattgagagaacataaatgataaatcaaatgggttaaaaacaagtgattctgggtaaagactgtaaggatgttctttgtactatttttggttttgcaaccttcggagatgtaaaatttgttttaacaaaaaacctagaagcaatacttgtttcactcttcactctccccacttcctcgcttttgtctaccctgcaattcactgttaccaagcctgggtctccactcttccactgaaaactattctggcaaaaggccccagtgcttccttaaatgggacatccaacaggacttttttaattattcatcttgcttgagtcagtggcagcactggactcttctggcttcctgctgctgcttaaaaagctacacttctggccgggcgcggtggctcacgcctgtaatcccagcactttgggaggccgaggcgggcggatcacgaggtcaggaaatcgagaccacggtgaaaccccgtctctactaaaaatacaaaaaaaattagccgggcgtggtggcgggcgcctgtagtaccagctactcaggaggctgaggcaggagaatggcgtcaacctgggaggcggagcttgcagtgagccgagatcgcaccactgcactccagcctgggcgacagagcgaagattccgattcaaaaaaaaaaaaaaaaaaaacaaaaacaaaaacaaactacccctctatgctattttcttttcttgccttcatgaccactcctctttggctttcctttctttctttttcttcctctactcaccttttaaatgtgagtttcctaagattccttatttagatctcatcttactcaacatttccctaagaatattcttccatttttatggctccaaataccccaaactggagaggcagttaaatagttgattattaaaaattgattagtatattatttagctcttgctgtatgccaaccaaccacaaaaatctctgtagcattcaacaaaaagcacttactctcgtggatctgcgggttgtagaatttggctagtctgggctgggctttcctgggcatggctttaagccacagggtgggctcacatctactcagtgagtttctcaccctctgtggaatggtgggcaagttgggacatcttctcatggcaatggcaggaagcaagagagcaaacggaaatgtggaatgtacctctgaaggcctaaggccaggactgacccactgtcatttcaacccacattccttaggccaaagaaaatcacacagtcaagcctaacgccaaggggaagcgaagtctgctccatctcaggctggaaggattaagagtctgacgagaaagagagtgactgcaggaaagggtggggaactgcacctgtctgcagtaggaatgtatgaactgacttggaaactgtttcaaccttccctggcaggaaaggatgagctacggagagcagagttcctcaaggtggggcatcaacaaggacagatgagagggaaggagcagagagaagcagtctaccttgaagattcactcagtgaggaattttaaaacctctgcatctcgaaggtttccagattttctttccaccctagcattttccagggagccccaggagtgccatgctgcacttggagggctgctgtgcccatttctcttgtcacattccattagacagatgcctcagctgctgcaatgctggaaaatctagaacatgatgtgctgttccactagggctgctgcagcgcccaccctgcctgctgcagggcagtagctaagaactgcgagacgcgaggtttcccttgcccatgtgcaacctgcttacctatataaatagatagctgatcaagccttttttttggcaaaaattctctgacaggctaggagcaaagcacatgccagcaaagggcaaaggggctctccatagtctatctttgagggttcttgtgaagttactatgtgtggcatgaaggctgcttacatttttacatgcatttgatccctttaaaatggtccagaagaaagtggtatatgaaagtacattctgaaaccagaaacatggagcatgacacttcaagctacaggatctggagtcaggtgggtgttccccggtgctgctagccagctttgatcttaactctcccaagggtcaactcttcatctgggaagtatggccaatcctaagtcacagcattatataagagtgaaacaaaagcctgtgtgaaagtccctggtgtcctgactaacccacagtaggcgctgaatgaatagaaccttttaaaggtgttatcatcatcatcatttgcagcattgctggacttttttctcttcctagctcacctcctacaaatgtgttactggattgtgacaaatatatttttggacatttttagttgacaactgcaagtgatattgaatattgcaaattaattgacagtttaactgcttagaggatttctcttactttgggtaattggaaagtaggaaattaaaggaaaagcaaatatgatattatttgagtattatttatgaaataggctcaatatttcatttcaataaaatttcatgtattttccaaaaatatctactttttctactatactaccttcaacttatccaaaataaaacctaataagcaatagtaatagtcaacagtcaaatattgactaacttctgttccaggcagcttctaacatagttcccaagaaaccctacctccttataggtggccagaccagtaacttaacttgctacttctgagaagatgttttaaaagactcttccttattaatctctctctctctcttcttacttgctcactctgatggagcaagctgccattttgtaaacctaagggtaaaggaactgatgatgatgatggtctctggccaacagctggtaaggacctgaggccctcaatccaacagcccaggaggaaccgctgccaagaggaccccccacaggggacccctgaggccaccatgtctctgactgcaacctcatgaaagactcagagcttctgcacccaacttaactgtgcccagattcctgacccatagacacagtgaaataataaatgctgtcattttaagctactaagttaaggtaattttttacataccaatagataactgataaatctacattgtactaacactatctggaagtttagatgtaatctacgtaaaatggaaaggttaaatttgctggtttctggagaaacccaatggatctctttggagacaaaatgttctctttccatgtcctttggagcaggggttgttgtggagtattattcttagaaagtgaaatgctaagcttcagcattgtgggtcagtctcaacttgcaaagcaaaagtttagatctccatattctttttacttgtattcagtagctatgttatcttcctcctttccattgcctgagctattttctgcattactgatccctcacacagccatctcagcttactacagaaaaatacctcctggtatttagaatgttcaaaacacttgagcaagcatattcacaacccatactgttgccaaggctgaataattgggcttggaatatgcctggcaccatcactccagatgaagccctagacggctgccatcggctctgctttgcccttactgcttacatggaagtggtcatttaggctgtgaaatggtcagacagaggagcttaccactaagaagcctctgctgcatgacaaacaccctgcctcaaagattgtgcctaattcttgagtgggcaacctgcctctaaagcagatggatagagtgaaagcaggatggagatggagagcgagcacagaaatatttcagtctagggtcatattggcatttgggagcttgtcaccatctgctgttcccggggttcccagcttgctaatccagcttgcagatggattgacatttttcaatttcttaaatcttgggaagagttttggtggttctctgttgttgccatgaagactgggcctgttctctgtcaaaatgcagccaaggtctatagctaaggtgcctagattctaccacttcattatcgtgggcttctagtcttttcccgaggggagagtgcactgataattgtggactgcggggcaaaagcttattacctgtcttcacattgtgttgcatgggcccaacagcacatttttataaagagaagacaataaatttgaagagatgaggccaactcctctcaactcctcaactcctgccacacctgttccccatgactggccagtcatggacaatatctgacaaacactcccccttcccagggctccttccattaggatcactcccaggtgtgcagtgccaggaagaggggagatgcccaccctcactgccaaggagaggcaggggtgtgccagggcacttgggtgcagggatgagccgccattggcaactcagctggccccactggccatgccctcgcaggctctcagctttctggtgcacctggtgatgctagtgaccctcatcaggggtgaatgcacctggctggcatgatgaccagttgtgctgccgggcacaaggctcccagctgctctttgctctcttagtcctgggaggagctttgcactggatccagggagaaaggagtagcgcttggacattggtcccaatgtcaccgaaataaggcagagggctctttctttgttcttcctcattgttcctttgggatgaccctgtgacctatgacctgtggaagatggagccatctcagtctttctcctgttgggatgtggggatgtagttgagaattgcattgatcactttgcaaaagggcttcttcgtgaagacttaaggaacagctcatgtttcagtgtcaggaagaacagtcttcaattcctgagaaactgaccagtgcatgccttattgaaatgcaactgtggctgatttcatttgcatcttcccatcggccacattaggccaagaaccatatttgtggcccaccttccaccacatacaaggctgtatggccagcaaggcaacctttttttctggctctattttaacttcagaccctttaatctttatttggccttttaaaaatgcctctcttagatgtttctttcttttttttttttttttttactatgttgaattattatatcctttaaggtcattttccctgttcttttgcaatgaaatagaacataaatagtatacttaacatgctaaaataaacttttctcccaactgttatttccaagacaaaaatccattttatatcctatcccaccatgtagggactgcaaatgtagtctttatgttgtccttaagaaaatctaccaataagataaagcattttccaggaaaccactgagacacattgtatcctattcctgtgcagattacggtaataactgacaaatctctgatgtcacagagccaggtggagcacaggaatgacttcatttcttcaacaaatatgagttttccttgggagagctttgagcaagtcttctctggtgtgtggcttcagggcatattcatgtgtacccacttggctggacactgggagcagagtcagaaagtgggtatggaggcacttctctcaaatgactttacaatttaggagaaaatcctggttgcaatgtaattcttccagaagcaatgactaaatcagtcaattcagcattatagaaccatgcaagtgtgtgcattaagccctggaaatactggaggcattttgtggggcagcccatttgaaacacattggtgctgtgcttctgtgatttggtaaccagcagccacatgggccacctgagtcaccgagctgcctaaaatccgtagtgtacaggtgatgagggggactcctgagagaagggggtgaactaggtgatggcatcctagtgagaggtgacagcgtgctggcagtggtgacagcgagcccttgctcgctctgggcgcctcctctgcttgggctcccactgtggcggcacttgagcccttcagcccgctgctgcactgtgggagcccccttctgggctggccaaggccggagccggcttcctcagcttgcagggaggtgtggagggagaggcgcgagcgggaaccggggctgcgcgcggagcttgtgggccagtgggagttctgggtaggcatgggcttggcaggccccgcacttggagcagccggctggccctgctggccctgctggccctgggcaatgaggggcttagcacccgggccagcagctgtgaagggtgtactgggtcccccagcagtgccggcctaccggcgctgcgctcgatttctcgccaggccttagctgcctccccacggggcagggctcgggacctgcagcccgccatgcctgagcaccgcccctcccccatccgcccccgtgggcttctgtgcggccccagcctccccgacgagcaccgccccctgctccacggcgcccagccccaccgaccacccaagggctgaggagtgcaggcacacggcacgggactggcaggcagctccacctgcagctccagtgcgggatccactgggtgaagccagctgggctcctgcgtctggtggggacgtggagaacctttatgtctagttaagggattataaatacaccaatcagcagcctgtgtctagctcagggtttgtgaatgcaccagtggacactctgtatctagctattctggtggggccttggagaacctttatgtctagctcagggattgtaaatacaccaatcggcactctgtatctagctcaaggtttgtaaacacaccaatcagcaccctgtgtctagctcagggtttgtgaatgcaccaatcgacaccctgtatctaactactctggtggggccttggagaacctttatgtctagctcagggattgtaaatacaccaattggcactctgtgtctacctcaaggtttgtgaacacaccaatcagcactctgtgtctacctcagggtttgtgaatgcaccaatcgacactctgtatctagctactctggtggggacttggagaacctttgtgttgacactctgtatctagctaatctggtggggaggtggagaacctttgtgtctagctcagggattgtaaatgcaccaatcagcgccctgtcaaaacagaccactgggctctaccagtcagcaggatgtgggtgaggccagataagagaataaaagcaggttgtccgagccagcagtggcaacccgctcgggtccccttccacactgtggaagcttagttctttcactctttgcaataaatcttgctgctgctcactctttgggtccacactgcctttatgagctgtaacactcactgtgaaggtctatagcttcactcctgagccagcgaaaccaccaacccaccagaaggaagaaacttcgaacacatccaaacatcagaaggaacaaactccagacgcgccaccttaagagctgtaatagttaccgcgagggtccgcggcttcattcttgaagtcagtgagaccaagaacccaccaattccagacacactagcaccaactgaggatgatggcttatggatttcccaaatttaaaactgggacttctcaacagagaagctgaacacgaaagcttcaccaagccattttccttttgataagaaagtgctaattagcaccatgcattctccatagaagacttgttttcacactggtttacctacggatggagttttcatgtaaatcatgagtgacagaggggcccatcatcaatgtttaaaacggaatgtgtacatggtattgctcaacctctttgagaaatatgaccccatcatttcatattagtagtacaagtagtcatttgaaattccagtcacagcagttcctgagccacaaacatacccacaaaacacatgcttggatggcgtgtgatctcacctgcatttacacttgatcaagcctttcatattgtagacagtttatttcttcctcattccatccttgaattgttaggcctcaaagagatgaggtattatgtgatagtcatctttgttcctcagatcttagtacatttccaccaggaagcagacatttaaaagtgatcattgaataaacagagttaatggaaaataaaaataattagtctcagataacacttttcggagttaactgacatgatgtttccatatttgctgggacattttatccttctctatttgagaaaccaagagagtagacttcatcaactcaggcaggtaatcttacagccgaaagccatgagaatgctttggagattcagaagtctagatcccaagtaaaagactgtcaactcctaccacccaggaaagaaagagattccccagactggagagagaagagaaatcagattgaaaataatagcagctaagatataggtggcctctgagcaaagggtggcactggtgtccaacccacaccaagcctcagaggtgctgacaaggagtgcaggacagctggagccttgaaacagcagagacctggccccaggtagatggtaacgaagctgcaagagccagagtagaagtgtctgcgtggtcggcttcttgcttgagggcccaaggcagccttgcagagctcccagggccccagtgaggtgcaggactagctaaacactccaagcatccaagcacttagcctcatggggttgcccaagcccagtgagcatgagtaggaaggggtagaatgcatcttgggtatgaatgcagggcagtcgccagatctacagatgagccaaacagaaatggggaacaatggagacacatgaagcctggaaagcaaagaacagagatgcaacaggagagtctgaactctgaagggacaactaagtactggatagatcaagcccctgtctcctccccctagattaaatagaaccctagaaaggttggcaaaacccaaattgttagactacatttctaccaccccaatagaatggggtctcaaagttgagttatagaaaaaaaaatcttgcacaacagagataatgtagattaaacttatctacattatctacaaataacaaccatattgcctgcaatacacaaatgaagatgcaatatatctgatattagcacagttttcactggtttcataacagacatttttaaaaataagggaacaaagttccaatatgacattgcatttacacagtgttttcacgacctgaaattcaagtgcttttagacaaaatagtcttttacacagtcactgttggcagaccgccaccatgtaacttgtgttttcaaatattcaaggtaggagaaagggtcaggactcatttaggaagtctggtagaagtcaagtttgcaaaaaatgaatttacccaaatgtatagaaggcttgccctactagggtggcctatttcatgtggatgtaaatagttcatgggggatgagagctgctgggaagtaggggagtaagggatagagaagcccatttcccagatgagctgaagaaatggagagcgaaacccaagggcaagtggcacgtctgcaagtagagctcttgccagcccttagtggcagatctgggaacatggggtttgcaagactcaacacactccattcttggaggaaaccagtggctccttgggacccaaagaagattccatggcatctcgatctcagcagggaaaactgaggcccggcgcagttaggataggctctcttgttcaggactgaagaggcttccctgatgcaggcagggagttggtcagcgtctgctgaggagacaaagcctgagctatcttctggctcagagagaaagagcaggcaggaagaaaaaccagcatccagctgtgccacagatgtgcttccacctctgtcttgccctctcaccctcgcctttaatcccattttataaaaactcatactcagaggttagctgggttggaccccagtctgaccaacccacagcccaggctggccacaatgtgtgtgtgtgcttagcaggggggcagtttttggggactgcaaaaggagggtctataaagaaggacctcatctctcaccccctaggggcagcctctatgggggaggacgatggtccctgacatcatgggacagtcacgaatgagggtctgtcctgggtcaggctggtgggcaagttgatctggcctctccacaaggctggctcttgcctcccccattagtcagtagcactgctgctcgtggctctttttagtttctgccttatgaccatatttgacacactgcctccaacctaaggtccctatttattcttgggcacacgccttggtgacatgctaccactgccctccctgcccagaattgtgtttggcaagctgtggagaagcttccagaatccaaaagacccttttttttaaatatactttaagttttagggtacatgtgcacaatgtgcaggtttgtttgaatggagacaattagtttaaagcaggcacgcgtaaaaccggaggcagcacttaaataaggcacaaacatgcctttaaatgttgttttaaagtcaacctttactttcatcctcaacgacttaattgacagaaacaacaagtgtatctgccaatatgtgggccggctcagtgacccatccactgagaagtagaaagcatatcatgttttgagttacagtttattgagcattaagctttcttcctgttttttctcacttttcagagtgatatccacagatattttcctataactgtgtgtaacatgactgtgcccaacgttagactggtggaatggtagataaagggggcaagaattcacaaaagggaagtcctgggaaaggaaattgagagtttataaatatatgaatgccagctcatttttattttttaaatactctgtacaacacaccaacataaaatcataggatatagtggtgattgcattcttatgcatatatctttgggtattaattttacgaaagatataaagatgattttgatgcagatggattccacatgttactgagaacatgaaaaggaggatcagacggaagcaagagaaaaattccaccttaggctctttcttgaaaggtgcagtttctccaccattgacatctccttagacctcacagtgaactggcaagtaggtccagggaagagatttctatagtatcttggctttgagtaaaagaaaatggacccaaaagcctcatcttcacaagacaaccttttggaaatagatagaaggcttgataccaaatgtgcttgaggtgtagctccaaagcagcaaataaaggcgctgccacacctgtgcaggtgccacacccgtgcaggtaccatccagtgggggcctggggcatcgcatgtcccagagcacccaggcacagggaggctgctcagcagtaggatgtgtggcttttgaggactcaaagacacttagggggtctctgcttctgcatttccaagaggacagatagctggggcaggtgcaccaccccactgagacaccagggcatgaagagtggcatgatatggtttggctgtgtccccacccaaatctcatttatactgtagctcccataattcccacgtgttgtaggagggacccagtgggaggtaattgaatcatggggcagttcccccatactgtcatcatggtagtgaataagtcccattagatctgatagttttataaggcatttcccttttctcttggctctcattctctcttgtctgctgccatttaagggatgccattgtgaggcctctccagcctcatggaactttgagtctgttaaacttctttttctttataaatcacccagtttcaggtatgcctttatcagcagtgtgaaaacagactaatacatagcacataggtggactgaaatccgctgtcccccatgagtgtgtaccgacaggtatgccctccaccagctgagcacaccagcacccacctcccctccctgacctgctcgcagccagcccacgcccaagccctgctgacattcatctcctttatctcttagcctgacaactcccctccttccccaccacactccactcaaagcaacgtcatctatcacctgaacctcctcactgactgctctgcctccactcctgcctccctcccaccggcatctgtccccaagctgcatccagactccagggaacacaaactcagccgcggcacccccttcgctgcctcctcctcgtgtcttctgttgccctcgtggtagggactgacatcctgatatggcccatgaggccccctggagtctgcccccacccagcggcttcctcaccatcacaacggattcccctctctgagcttctcctaggtggccatccgcccatgcctccaacattctactctcccttcttccaccaggcatttgcacacctgcagtttcctctttctgaaatattccttcagcactccttacttaataaattgctactcatctttcaaatacagccaacttcccattcttctggaaagtattcctggatccctggaaaggccacagttcccatgttgtactccatgtgtgtctttttgcagcacttacatgatttccattttacctgtggttgtgtcactttttgataactagctgtccttcctactagaccagaagcttctggtgggcaggacatgtctgcttttacaaatcatggtaaccatggtacttagtttagttgttgacatgtagccagcactttcttattcatttgctagttatggttaacgctgtgctaaactctggagtttaaacaatgaaccaggcaggcaaggccttgccttcatggtgtttttattttattgcaagagagatacaaacacaatagagattatgatgtttacaatgtttaaaaataaggactgctatgatagagaataatggcaagatacatggagtcatcagcaaagacctcctgaagcaagtgacatgaaaacagagatccaactggtgggaaagaacgagatttgcccaaaccagggaggaatattcccaacactggaagcagcaagagccaaggccctgaagcaaggacgagggcagcctttagtaatgtgtccagaaggcccgagttcttggagcagagcattgaaggaaatagtggttgataatacaactggaaagatgtgcagcgaccagcagaagaggaagagtttggatgttattctgagtgaatgggggagtcattgaggggactaaggcagaagaataaccacacctcgtttacatataaggctctccaggtgggctttatggagaaaggattgcacagagggtggcttggatagggcagagccatggacaaggggaagatggaaggagatctgtcccagaggcatagacaggaggccagggtgtccttaggaattctggcttccatagcagggtggatggtggctcatttactgaggtggagaagactattgaagaatgcatgggttgatggatgaataaacaaacaagcaaatatgtagagataaatagtacaataaaggagactgggccttcagggtgagatatattcataaggcaaaaaagcttccatatcggtcagggttctgctgagaaagagaaccaatgggatatgtatataaagagatttattttaaggaagtagctcacatgatcatagagggtagcaagttgatatttgcagggcagcccacaggctggaaactcagacaggagcggatattgcaatcttgaggaagaattattttcttcccagggaaaccttgtatttttttctcttaaagctttcaactgattaaatgaggcccacacatattattcatgataatctcctttacttacagtcacctgattatagatcttaaacacatctgcaagatgcccttcacagcaacacctagatttgtgtttgattaaataactgggtactataccttggatacattgacacataaaaataacaatcacaactctaaatgattgttccgtggaaaccactaggctttaccaataatataactcagaggtcagcaaactatggtccatgggccaaattttgccttccatctgtttttgtgaataaagttttattggaacacagccatgccaactcatttgtgcattgtctatggctgcctttgtgtaacagccacagaggtgagcagttaggacagagaccaaacagcccgcaaagcataacgtatttactatctggccctttacaggaaaactttgttgagccctggtgtcacttcattttgtggaattactcaggcaaagtgactgctgctaggcaatagtcaaagtcaaaatggttaatgggtctgaaaccagtggagatctgggaaaattttaaaagaatagtcaaacatgacaagaggtatcactggggaaaagaaacccaaaacattagcatttggcttccaagcagctcacattctggccttagacaactgttacctcactgctcagaaatggaagcttgaagctcgtgtggaaaaccgacctcctaataaatctcacacagaggatgcagcaatttgttatgcgtgagaaaatggcactgggaaagcaaaacacagccagcttgcttcatatcacaagtagcaattgggctcaggttttcacctaatttttaagcagcttatcaccacctccgaaaagaaaaaaaaaattctaaaaattgcattgcttttttttttctgagaagagcatattatgaagtgtaaacattaagaaagtcatttcccaatataactatttccaagctttgtctaccacttgtgctatcatccaaatgttggtgtccccttctccctgaaaatttggatgttggaacctaatctttagtgggatactagtaggaggtgaggcctttggggaggtgattaagtcatgaggtcagaaccctcatgaataggattagtgcctttgtaaaagacatgtgagagagcctgtttgccccttctgctatgtgaggacaccatgagaataatctgcaggagatgcaagaagcagaggcccttcactagacatggcatctgctggcaccttgatatcagacttcacagcctccagaactgtgagaaatagatgtctgttgctaataaattacccaacctaaggtattttattatagcagcccaaactgactaacacaactcactacctttaaatatttttgtccaatcaatacagctccctctcccttttttggggaataaaaccttgctgaaatgaacggactctaatatcttgatttattaacccacatctgagccaaaatgatgtttgtttgagaatctacttagtactgactgaaagaaactgtacaagaggtttttttgccaatgtgtgagaaaatagatcagagataagattaatctttacaaaagacaaaaagcttacaatgctttgccaaataaaattaactttcataatttgcctactatgtatttactatgctatgctatctgtttagcatacaaaccccctacaatccctacagtaatcctagatggtgcctacgttttaatctcaggtttatagatgagaaactaagacaacctggacttaaagccaggccaccttactccacaggccacaccccccaccacggtgaacactacagctgtgataagacaacagaaaattgcttatccaaaataataaattatatatttatattccccttgactcacctgaatagtgttcatttttatttagaaatgtaactgtattcgtttgttctcatactgctatgaagaactacctgagactgagtaatttatgaagaaaagaggtttaattgattcacaattctgtaggctgtacaggaagcattgctagggaggcctcaggaaacttacagtcgtggcagtaggcaaaggggaagcaggcgcgtcttcacgtggtgacaggagagagcgagcaagggggaagtgccacacacttttaaatgaccagatctcctaagaattcactcactatcatgagaactggaaggcggaagtctgtccctgtgattcaatcacctcccaccaggcccctccaacactggagattacaattcaacgtgagatttgggtgaggacacagagccaaattctaacatcttgatttactaacctacatctgagccaaaataatgcttgtttgagaatctactttaagtaacaactgaaaaaaatttatgagttttttattgccaatgcgtgagagaatatatcacatactgacaagataaaataagattaatatttacaaaaggcaaaaagctcacgatgctttgtcaaataaaattgataatttccctaccatgtatttactatgctatgctgtgtatcaaacaaaaccccctacaatccctacagtaatcctagatggtgccttcattttaacctcaggtttatagaagagaaactaagacaacctggacttaaagccaggccaccttactccacaggccacaccccccaccatggtgaaaactacagttgcgatgttaagataacagaaaactgctattcataatagtaaattatatacttacatccctcgactcatctgaatagtgttcatgtttatttaggaatgtaactttttaaagaatgcaaagttttatttaagaacctgcaaagttacctcatataacagcaatattcctgccattatgctgcatatggagatagaaacctataacaatcatctttccctctaacttgcttccaccttctccagtgggtgacagaaaagacagataggacctgtacatccagctttctctgctaccccttgaaaaagctccatctattccaatcagtgggcatgcagcttcctggttttcttacacttgctgttactcatagagtatctcgtgctgttgtttgcatttttactagtttcagcttattttagggtttcacttaacgcacagctttgtacggaaagtcatagattccactgctcctctcagtgttttacacaggttttactgaaacccaaacccctgcctagcatccctctttttcttcctcacttcccatggcaaagtcagaatttattcttgagatttcaatcttctcagccttttagctttcctggctgtgggaccgcagaaagctagcactgcagctatggtctagcaggacagcgtcccagccttattccctctgcacttaccatttctgtgaacactggctcagtgtccaaccacaagccccatctgctctcttgtgaagtggaccagaagtgtccaggattaatgctgcttaggctgagagtaggtggatcaacatcccagctccctcacccttcctgtagatgacatttcagtttcatgttctacactttctcccagagtttctcaatggcaccattctccagttggccacggtggtaaattgcttggtgatgcattttgtatctctgttgtgccttgcaaaacccacttcctaattgctgtttcttgggatggcctcccaaataaagtacttgtgtttgacatcttatctcaggtcctgctggggaatccaaattaagtcagcatgctgtataacataccccatctcccctctctataaggacatttcttttagactatctcttatttcagtcctgagctccaccttgtcaagtattctggatacccatgagggcttagcaaaagggcctatgtctgtcaccctggatgggaactagccacttcaggaaagctctgtgatagccatgtgtaaggtcatagttagaaatgcccccaccctttctcattaagttctccctacccttattcacatttggcactttatttaactcttcccattcatatattttgagacttaggctgaatttagcaactttacatcttctaccctttctcattgtgctaaagtctccatcagggtcatgcaaatggggaaataaaggttgagcaaatggggaaatattattctccatatggattgtgaaagtgtgcaacctataccactgtcagcagcagctctggtcttcatcctgccccattgttttctgaaggtgcacaatccagcctcctactagaagaacccagactcttgtttccccattcacaatgggggtgttcacttacacattaggtcaacatagttgcaggaggttctagaatctagccactttggctctatcacttattagctgagtgaccttggacaagttatttaacttcccaccagctcagtttctcatctggaaattgagaacaatttcaattataacaatgtcataaaatctttgtgtcaggtgaaatcatgcatgctgagtgctttgacagcacccagcattttgcgggtttttgacagatgtcagtcaccaccgactctctgtcttccccttctgcaggtccagcctccagggcgatgacaagggtgagagagaaatatgagcccagcctgccaggtcaggaacaaggagagcgaggagctgcctttccttttccctggctccttccaagtggcagtgtggacaaacagaacaggcaagatgctgtggatgtggagctgaatgattcatcatgcacatcaatttaaccagagtcagttagcagtatcccaaagctctgaaggacaggggctcaattaaccttttaatacacaagtcaaatttcttgtcttcatgacttacttctttaccagcaaaaagcctccaaaacccttctcagatctttgtccaaggtgaggctaaactctgtcactggtggggcttcctctaattccctgtgttgttctgtctgctgtgatgttatcactctaagagggagggtgcattttgaggatgacagagaaggacacgtatgatgcagtgttaacgcagacctttctctccacctggatgaagaactacgttctctggccgccctcatacttgtcgttaaaagaacgtaaattatttcacaattctctcccctcaaacacacccactatttctctttcttcctgcaagagctgagtttttttctcttcaggataaactagcacattcttttaattcccaggaaattatacttttccagggatgattaccacccattctcagagtttataagtccaagggtaaggccctgatccaattggggctggagctacagatgagaatgaaaatgacagaccatctctgtgtgctcctggactgtgagaggtaaaatttggaatctgacagctgtcacgtttcctgataaatgaaccagagaagtggagggagaagggaggcctgggaaaaaggcgctcctcctaggcttcaagtcctgaagccaaagcacattctttactttgagtcccaaaaggcaactcattattattccaataacaccacctttgtttagtctgataggggtacggtttctgtcactagccaacctagcgatgattattacattatttaaattaaacacccatttctatttttgggaggccctcgtgggtgatcaacctgctgatttatgaaccaattcatgctacggtagtgatggggaatagcagttaccacactatcttttgttataccaactttgccttgacacccaatgtttaatgtcttgacctaaagtaatgactaataaaccccaatgccagcaaagaggaagcccacagagaaccagcatcagtgcagatgagtctcaaggcaacacccaaatatcccactaggcctctctcttcctgcatacacatatgttaaggcttgaatttaatttttttctcacactataaagctaagctgtgtcagtaatccccatgccaacctgctggagaaaaagtcaatctaacatcattacatttttctggctattttaattcagttaaaaaaataaaaataaaaaaccacattttccctagtacctgcctatttctagaaaaagctaactggaaatcagaaacaaagaagacagcctttaactgctttattaatgggagcttggtcatgtcatttccaagttcttctttttccaaaagacccaactgatagtcccgtattcataaggcacctgctccctcacccctacaagttcaaatccagttttctttcccttttggagcttttcctggtgaaattatagcttctcatagtgaaggtgaacagcgtgctggcttatctggtccctccgtcaccttccccacccctcatctgccctctgcaggtcagggtgtcaacagtctccaggacaggtgttaactaacctacccctggaggcactatgtgttgggcagtgagaaacccaaactacattccagactcactcatttgaaaatggaattaataaaactgggaattaatgaataacaatattttagaaggagtcacaattgcaagatgccctgctaacccagcatccaaaaaactgctgtttactctgtcatctttggcaatacacaccattattacatcttagttgcttaatccgtaagaggcaggtaagatgccaagcaattccttggagttatggtaagttattcatgcaaacactatatttattaagtgattcaagcataaaggtcattcaacgcttacgctctctttctaatgcccttctgatgctccttcttttaaagcctggtggcaaaagcactcccaactcagaacacaggagtacaacttgaattcagagaatttaagatgatctctaaatcaggatgagtcttacaatccaagctatgtcttagaattacataaaataatggtgcattttatataatcagtggcattttagatttgatgaaatacagcaactgaattagtcctcccagaattcaaggtctttttaaagcaggatttaattcatatctcagtagctttccccaaaattttcagcaattgcaccctgcccacctattcatgaagctgagagggatcacaggagttgtctagtcccaagtccccagagatgttttctggtgatagactgtaaccaaaacgacctctggtatttattaagtttgcaaaatcttgtgtcaaagttttctcagagccttttatatgctaattgaaattatggatttgtccgaaaggtgttctagactttagaatttccctcacttatttgaccattaaaccttttatcctaggactgatttgtaggcgaataaaaatgctgaaaaaaagtgagaccttgaaagattacacaacctgcccccaaagacccagttaataagtggtacagtaaagaatgcagtctggcttttcttattctgcttctgattctcctaccacacagcactgcttcatggatcagttttcaatgaaatgaataaaaggcaccatggtgtagttctctcttcactcacgcacttccctcagaatttcaaagccaacgagttaacaaaaagacaaatttacactggaaatcaacaaccatctaagctgtggaattttttagtgcattgtgatgtccattaaaatctgtcacccaattgccttccaaaaccccagagcaactgaaacacacaagcgtttttgagtgggcaggggttaaggggcagaagccaagagaggatcagagacatctcccagtaacacaggggcccatttccctgaacctgtcaaaacctttgagcaggtaacaccgaggagtgggtctcctgtggctggctttgcaactccttctcttccgattatgaaaatatccttcttacactgcaccgtaatcatttgaatttttattgttttcactcaaaagctcctaagttatttagataagcaccattaaacaaaaatctgagtaattagttcttttgatgtgtcctagtggcagtggaggaacttgaagacgtttattaactgttagatcagtcccaggtgggacttattataaacagagcttagccccagagcagccgctcattaaatactgaacaggaattaggtatttctctcttcccatgccattcttcatcaaccagcctctaccacttgggtaggattattatattatatattttatgccactaaataccacaaatcattgcttacgtgaagtcccggaggtggggctagaacacaatcacaccctcctttagagactgcgacccagagagaacaatcagaagggactcccagagatccgctatttaatcctctcatttggctggtcagagacagagatccaaagaaattaagagattttctcaaggccaacagctggtcaatgggacccgcttctcccatctcttgctttagtaaattttccatgccaagacattttcaagtgcttgacagtcacccacggatgctgactgctctgagtgatctatggcaaaccacccactcttttcccagaatgataaatgtttcttatgtctaatgttgatataaaatgttatgaaaacgagaaaatttgggggatcttagaaaataaaagaaagatttacatgaaataaaaatgagtggttttatctcgtgtatgttggaaaacagaatagaagttgattggcatccatggcagaaggggatctgggttctcacttgttcccacctgttcaagcatcccagtggagtcctcagtcctcaagtctgtaaaccaggctgaacagccccaggtgaccgggacacagtgggaagtgagtcaactaacccctaaaagctcctcccagtcccagggtcgtgccttcattcttgaaggtcggtttctctacagcataaacgtcattattcataaggctttctcccctgtgtcatgtaacatagggcagcacaaacaagactgtttttttttaatacatagatggagtttcgctcttgttgcccaggctgcagtgcaatggcacaatctcggctcaccacaacctctgcctcctggggtcaagagattctcctgcctcagcctcccgaatatctgggattacacgcatgcaccactacgcctgactaattttgtatttttagtagagatgggtttctccatgctggtctcaaactcctgacctcaggtgatctgcccgcctcagcctcccaaagagctgggattacagacgtgagccaccacgtctggcctgcacaaacaagattttaaatatgttttcctgttactctccgagtgttttgctaacagatgatttgcaaagaatatacatagaaagacagctctcattcacccactgagaatcagcctcctgaaaactttaggcagactcaataaaaataaacttatcactacatccctgctcctaagttccatgcagaacacacatcaggagtctgtagcaaaatacctctactcccctgagagatttgtacatgctaatctcaatgtccctaacatagcatttaacagcttcaccagccacatggaaacagaagaaacaccaagtttttgtggggaaaacatttcaaaaggacaaaatatctttgaacctgactctaccttactatcatttctcatttttatgtcttatttaagatctgtgaaaaacaatccaaggtttagtgctgattttcttaacaaaagaaaatactcaaggttgttttcataaatagacaatcttaactcaattttcttctgttaccacatgccacatttaaataacctcaatggccaggaaaacttaaaaagggaactttcatgagttaggtagggcttggctgcatctaattcaatgtcattcacaagaaaagctaaaaatctttacctgcctgaagttcttaatggaaggggaggaagaaacccaaaagataaatgaacaatgcatgtctaaattaaaactgaaccaaaaaaaaagacatcagtcagagaaacagtcagagaaacagagagaaaagtagcaactttaagcatgatgaataactgatccacatccttagcaaaaacaagatctcatcaggaaccaatcaggagcaccaacctgaatttgctgattcatggaaagcaataggtgattaaaaaaaaaaaagcctgagcctctttcttttccatttccccaaccagacaacctgcgaagacactacacacttatgatacattccagattaactttaccaaccaactctcttggactttactgttaattagtgcagaggcaactcccttttttctcttctgcctcccaggcttcccctctggatgctaatgaaatagggagatttctaagtttcattgtctcagttgagcagtgctattctttttttttttaattttattattattatactttaacttttagggtacatgtgcacaacgtgcaggtttgttacatatgtatacatgtgccatgttggtgtgctgcacccattaacttgtgattcagcattaggtatatctcctaatgctatcttttctacaggcaatatggaaaaaataaacatggaagatttctggatggaaacagtttacaatcaaacatcccattgttgacaaaatcatcataattgtcacttcgcgcctctttgccaactgtataattagtgtcattaccagtaagtcatggaaatataaatgatagtggattatacaacccaaaactgcataaacatgaatattttatggtacctaagcaatgtcacgaattgtacataacatagacttggcatttgcttccagcagatcttaagatttctcacccagactaagtgcacagtcttaccatatagctttagaaagatgtttctggatggatgttaccaaaggcaagtgaggaggaggaggagaggagggaaaaaattctctttggaaatgatttttaaaaacacaattattagtgtatttttatgtttaggacatgaaattccatttttatattttcctacatggaatataatttcaaaagaaaatatttttaaaataacaatttaaagccaaatgtattcaattttgtattgcctactatccgatcactcatgtttggatactttggcaaatatgttagaccagatcactctgcacccaagttgcctatactctccctgactggggtgatctcttcctttcccctctgcccaagaccagctcaagacacactgctctctcccttctttgaatttctaaaggccagactctggaaaacataggttttgacatttttaagactctgtaaattatggcaatcaaactctttttgtttgtgtatacatttggaattgccatacttctacaagcactcccgtttttagtgtctaatattgggccggtgggtcataggtactctgtcaatatgtaaggaaaattattaagtggacacgttcattagtttttatggaaaataagatgggaatggaaaaatattggataaaacccaactattcttttcaacagaattagatcacaccctggtaatcaaaagcatccatacagcaacaagtggtccgtgtggtccttaaaacatgccagtaggggttgagaaataccctcctaatcaaggtgattattcatgacaaacttgtatatatagtaagggccaggtgagtctttcatgacatcattagattatcagatctttgaggaaacagagtggtgtctggtttgtttatagctgtggtgggcaaaacaatggcccccaaagacatccacatcctaatccctggaactggtgactatgtgaggttataccaagcaaaaacaaagcacaaagtgttcttttttctttattcttaacctagaaaatgtttatcatatttaaattttccattttgactcagttactgtgctttctgaacatgtatacaatgttatggtgaagtttcagaaaatctttgaaatctgcagctgcattagacaaagagtataaatgtacctgttcaaagtttaaaacataaatttctgtttgaaaaacgaagatggactgataggttgaaacttcatcttacaaggtttatagtgacacaaagcagttgacacaatgacatttctgcttgaggaaacttactgtgggtacattgaagagaatgaattggtggaaaaaggctgcgggcagaccaagtaagaagttgttacattaaccccagcaagggatgcagtggcctggcctcatggcagtggggctaggcaaaagtagatgaattctaggaaaggttaggaggtaatattgacaggagttggcaactggaggaaaaagagggagaagtcaatgggatctggaccacatggtgaaagacaaccgttcagtaaggagcagagcatgagatattatggttgagtatgaaatttattatggttggacataatataataagttgaagggagagatttttttaagaaacatatatttggaagtcattaatatatgaatacaaatggaggtcactgagtatgaaaacacccagggtagcatagccaagacaatactaggcaaaaagaacaaagctggagtcatcacactacctgacttcaaactatactacaagcctacagtaaccaaaacagcatggtactggtaccaaaacagatacacagaccaatagaacagaagagagacctcagaaataacaccacacatctacaaccatctgaccttcaacaaacctgacaaaaacaagcaaagaggaaaggattctctatttaataaatggtgctgggaaaactggctagccataagcagaaaacagaaactggaccctttccttataccttatacaaaaattaattcaaggtagatttaagacttaaatgtaaaacccaaaaccataaaaaccctagaaaaaagctaggcaatatcattcaggacataggcatgggcaaacacttcatgactaaaacaccaaaagcaattgcaacaaaagccgaaattgacaaatgggatctaatcaaactaaagaacttctgcacagcaaaagaaactatcatcagaatgaacaggcaacctaaagaatgggagaaaatttttgcaatctacccatctgacaaagggctactatccagaatctacaaggaacttaaacaaattttcaagaaaaaaaaccaaccccatcgaaaagtaggcaaagcatatgaacagatacttctcaaaagaagacatgtatgtggccaacaaacatatgaaaaaaaggtcatcatcactggtcattcaagagatgcaaatcaaaaccacaatgagataccatctcatgccagttagaatggcgatcattaaaaagtcaggaaacaacaggtgctggagaggatgtggagaaataggaacactattacactattgctgggaatgtaaattagttcaaccattgtggaagacagtgtagtgattcctcaaggatctagaaccagaaatatcatttgacccagcaatcccattactggatatatacccaaaggattataaatcattctactataaagacacatgcacacatatgtttattgaaggactatttataatagcaaagacttggaatcaacccaaatgcccatcaatgatagactggataaagaaaatgtggcacatatacaccatggaatactgtgcagccataaaaaagaatgagttcatgtcctttgtagggacatagatgaagctggaagtcatcattctcagcaaactaacacagtaacagaaaaccaaacatcacacgttctcactcataagtgggaggtgaacaatgagaacacatggacacagggaggggaacatcacatacgaaggcccatcagtgggtgggaggcaaggtgagggagagcattaggacaaatacctaatgtatgtggggcttaaaacctagatgatgggttgataggtgcagcaaaccaccatggcacatgtatacctatgaaacaaacctgcaagttctgcatatgtatcccagaagttaaagtaaaataaataaaatttaaaaagaaaacacccagggtaagtgtacagattgaggacctagggaaaaacctctgaggaacatcattttcaaggaacaggacagaagacaaattgacaaaggagactaagttcatgactagatagaataaaaaccaggagaatttagtgttatgatagctaagagagaagatttccagatggtggatattaaccaagtcaaatgctgctgggaaatgaaacaagacaaaagattgggcattggagtttgcaatatggatatcattaggaacctggttgagaatattttagtgaagttttggggacagagataggcctgaagggtgttaaagaggggtgaatgtaagattgtgtctttgaggtgctatacaggaacacatgagtggggtaatttataaaggaaagaggtttatttggctcacagttctgtagaacattcaaaaagcatggcaccagcatctgtttctggtgagaaattcaggctgcttccactcaaggcagaatgggagggggaactggcatgcagagatcacatggcaagagaagaaacaagaaagaggtgaggaggtgctgggctctttttaacaaccagcttttgcaggaactaatagagcaagaagagaactcactcattaccataaggatggcaccaaattattcacaagggatacgcctccatgacccaaacacctcccattaggccccacctccaacactgagaatcaaatttcaacgtgcagcataagggacaaatattccaattataacagagcaccaggggagaaagtaggaaaaacaagtgggacacctctttcaataagtttagctaaaaaggagaacaaaaaatgagatggtaaagatttgtaacttttttttttttttgaaaagagagaaatgctaatctggagaggccagtaaagaggatgaggttgaaaattcaggtcagcatgaggataactagtgtcacaaggtacctggggagctgggatgggtctagcccagggattaggggatgtgttatggataataataaaaaacatgtcttcactgtaatgggatggagtgaggaaagaatggacatggtggctgcaggtgagattttcaatatggtggaggaaaactgaagcagtttccttctgctggctttttattcttctgttaagtaggacatgaagttttctaaatgcttgattttgaaaggagagctattctagcatttaaaccaaacttttaatacaaataaatccaagattttcatgtggtaccatctctgcataggtctaaatttttatttatttatttatttgagacggagtcttgctctgtcacccaggctggagtgcagtggcacaatcgcggctcactgcaggtctaaatttataagaccataatctaatggtttaaaacaatttaaaaagaggttgcaatgttatttgatgctcaactttataaaagagcttgtcttagtctatttactgtagctataacagaatttctgagatggggtagttgataaataaaagaggtttatttggctcatgattctggtgactggagagttcaagattgggtagctatatctcatggagccctcaggcgctttcactcatggtggaaggtggaaggggagctggtgtgtgcagagatcacatgccatgagagtaagcaagagaaagagggagggagatagtaggcttttttcagcaaccagctctcaagggaatgaataaagcaagaactcattcaccccagaggaagggcattaatctattcatgaggagtctgcctctatgacccaaatacatcccattaggcctcacttccaacactggggataaaatttcaacatgaagtttggaggggacaaatatccaaaccatagcagagctcattcataatacacaaaaagaattctcaaccccctttgactcctctacaaatctctcacttctgtagcttctcaagagcctcccaaacaccaaaaatacccctccatacccagccagggccaactttcctttctctcttctcattctttgccttctagctctctattatgaaaataaactgaaggcttttagctaaatctttttctctttcttcttatttttagacttctcccccttctatccattttccagatttaaagttttccatcacagtagatccagcaacaggtctggaaaatacagaattttactcagaagactctaataggaatataaaatgaatgaacataggggaagaactcacacatgattaagtcaaggcacagccctctcatcagtaagacacaagctaccctcgtagaatgtgatgtcaaagttggagaatggcctagcatagccatcaccatttgtgtagaccttaaatgctgagggctgccccctcccaaaagaacagaggttaagtggataaaaaagagtgatcaataactccgaaaaattgaccatggcatagtgatgtagctgatactggacaaaatttgaattattgatcatgtacagcatctgtacatttaaggcattaattcttcagatactgaaagattctaaaaggaatgaacaggaatgttaaccacaggacttattggagactataggttaggctgagccaggaacaaaatccctctatgcattaataaacttagtaaacccacagggaatgtgggagatgctttccactcttccatgtagctgttgaagggctcattacctgtgcacacaaacaagagaaaaatcaaaattcctctcccataaagcgatacttcaaagaaattgtcttataagtcaagtacaaagaacaacaaaatcacactggattaacacaacaaaactgatttcctgctcatgcaaagttatttgtggatccagcaaccttggagaacaggtgtcctccaaggcaatgtctcagcctcctaggctgctgtgaacctctcttttctctgactcaacatgcatccatatggccactaaggggaaaagagtactggagagtttccatgctggacatacccctttgcctcttgagaggccctcaccagcattcttcaccctgattttggttgcaggaggcagatctgtttggaatgcataaatgagctatcttgtcttctggcttctcattcgatttgaccaataggatgcaccagcaggagatccaagggcagaaactgggtgagtttagggcgttattcctccactcacttcctgtgaaatcacagtggcctggctgcacccctctacggaggaccagcacttgctcacatactgtctgcctccctatctcttccactctctgcattcttgtacttgctcccttcccttgccttttcaagcttaggtgctgtaagacctccccagagtacaccaccatcctgctgctttcttaaaacatagcccacacctttgcaaacttaaactccagcctagtccctttagtaaactcttccattactcagattttaaatgatttgctctgaacgtggcccacatcacttccacttgaaatcatcgaccagaattagttacattccttgcttaactttaacaggaatgggaagtttaatcctctcaattacccaagagaaaggagaaccagatattggcgaaaactagaagtctactgctgagacctagcaatagacataatgtgatttacatgataattatagagaagcaggtcactttctcactttcatcattagaaacagcacataactcatcacaatcccttttcagtgtgcttccaaacagttggagcacttccaaaagcagtgatcaagtacaaaattaccaaatcaatcctcaaattggcaatcagattgaaataactgtttcctctcaggttaaagaagattaaccattagctctttagaagaataagcagggcagtcacagactttatgcaatattgattggatgtatcctcacatacaaatgccatagagtagctctcagggagctattacacaactgtctcaggagaggcagagataccatgttatacttcaatacgtatatgatgattgattaaaacaaccagaggtaggtgtaatactagctactggccagcccagaaatgaccagggcatgcagaataagaatagactggagtcaggagctggatgtctttggccacatcttttagtctggttccttaaatataaactaaggcaactagatcaaaggttttttatctgtgataaatggatctatctcattagatctgctaaaatgttacaaaattggaaatatatttgcttgtgtggttttctaatggaaaatattcacaggtttcataagacctacagaaatatcctataaccctcccccacccccaccaaaagaggttagaaccacagggctggatgatgtcacacactgcttccaaatccaacattttataattctatggtcacttctggtcaatatattggtctgatgaaaagaccatataatatattctcatgaaactaaaactttcccagtatagagacagcagacaggtaatgctcaatagaggtatgtaaatctgaatctgtatttatttttcctaatttttgaaaatgtcatctgtaaaaggtcagagaaacatctgttataaatgattccttctgttttctttttattatttaccccaaaataaggattcccacacttgctttacatttcatatttgttttactctcagtgactctatataaagtaagaggtatacaagagtttcctccaaatgagattacatgactattcaactttgaaacaagatcctgaaatacctatttaaataaccagtaattgttatgcacaaaatcttctccaaagaacaaactttaaaatggttattagcaactcttaatggaccaaattttctaactcaatgtcctaaggtacctaaaccacctgctctcagctttattgtcctgttgctttaattaaccataggttcagtttaacttgcattctaattgggtccttgactaattgtgcattaaatacttggtagcacaatacagataagtaactatcaactttcatttgaacatagaaagcaatctgggaaggcttaggatgtcattagactgtagttgatggtttcccgtggaaacaaaggagaaggaaaagattaaaatgactcaaaagcatgatcgatacccacaggcatacatcagagatcagaaatctttaaaataaagttttgtgttaagttagatacactacccattctggcattttcaaagtgtatttagggtgaggctgaattcaactccaggattcaggagaggttgaatgtgcagattcttataagaacttgtgagtatatgtcctggtattcactgtcttgtcagccaatgttagcttttggcaatggcagaaaataactgagtcctctgtactccagggtccatgtagctctactgaaaacttgtttcttctttacatgctcttctttccactctggctttcctaacacctaaatgtctgatatccctctttctccaacaattacttaaatattggtgctatctggccgtctagcctgaggcccctcacattgtttttatgcatgaatgaagaactcccacttacgaattcttagcaaatatatcattttttttatactttaagttttagggtacatgtgcacaacatgcaggtttgttacatatgtgtacatgtgccatgttagtgtgctgcacccattaactcgtcatttaacattaggtatatctcctaatgctatccctccccttccccccaccccacaataggccccggtgtgtgatgttcccctttctgtggccacgtgttctcattgctcaattcccacctatgagtgagaacatgcggtgtttagttttttctccttgtgatagtttgctgagactgatggtttccagcttcatccatgtccctacaaaggacatgaactcatcctttttcatggctgcatagtattccatagtgtatatgtgccacattttcttaatccagtctatcactgttggacatttggcttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaagaatcgccacactgacttccacaatggttgaactagtttatagtcccaccaacagtgtaaaattgttcctatttctccacatcctctccagcaccggttgtttcctgacattttaatgatcaccattctaactggtttgagatggtatctcattgtggttttgatttgcatttctctgatggccagtgatgataagcattttttcatgtgtcttttggctgcataaatgtcttcttttgagaagcatctgttcatatcctttgcccactttttgatggggttgtttgtttttttcttgtaaatttttgagttcattgtagattctggatattagccctttgtcagatgagtagattgcaaaaattttctcccattctgtaggttgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggtttcaggtctaacatttaagtcttcaatccatcttgaattaatttttgtataaggtgtaaggaagggatccagtttcagctttctacatatggctagccagttttcccagcaccatttattaaatagggaatcgtttctccatttcttgtttttgtcatgtttgtcaaagatcagatggttgtagatatgcggcattatttctgagggctctgttctgttccattggtctatatatctgttttggtaccagtaccatgctgttttggtcactgtagccttgtagtatagtttgaagtcaggtagcatgatgaacatcagtgtgaaaatcctcaataaaatactggcaaaccaaatccagcagcacatcaaaaagcttatccaccatgatcaagtgggcttcatccctgggatgcaaggctggttcaatatatgcaaatcaataaacgtaatccagcatataaacagaaccaaaaacaaaaaccatatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtcttggaagttctggccagggcaatcaggcaggagaaggaaatattcaattaggaaaagaggaagtcaaattgtccctgtttgcagacgacatgattgtatacctagaaaaccccatcgtcttagcccaaagtctccttaagctgataggcaacttcagcaaagtctcaggatacaaaatcaatgtgcaaaaatcacaagcattcttatacatcaataacagagagccaaatcacgagtgaactcccattcacagttgcttcaaagagaataaaataccttggaatccaacttaggagggatgtgaaggacctcttcaaggagagctacaaaccactgctcaatgaaataaaagaggatacaaacaaatggaagaacattccacgctcatgggtaggaagaattaacatcgtgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggtaaagatatcatttataaaatcttgtctaacatagatagtcttcctctaatttccatttcaggttttaaaaatttttgataagacaagggattagtcagatgggttaattccataatttacggttcattagcccaattcggtataccctcaaaactttcagcctaagaagagtcctagagatcctgcctcagactggggatatagctttgttaccagaaaagagtcccgatccagactccgagagagtagtacttggatactgcaaaagaaagaatttagggcgagttcatacagtaaagtgaaagcaactttattaagaaagtaaagaaagaaataggccaggcatggtggctcacgcctgtaatcccagcactttgggaggctgaggcaggtggattgcctgagctcaggagtttgggaccagcctgggcaacatggtgaaacctgtctctactaaaatacaaaaaattagccaggcgtggtagcgtgcgcctgtaatcccagctactcgggaggctgaggcgggagaattgcttgattccaggaggtggagcttgcagtgagccaagatcgtgccatggcattccagcctgggcgacagagtgagactccatctccaaaaaaaaaaaaaaaaaagaaaaacagaaagtaaaggaataaagaatggctattccattgacagagcagccccgcagactgctggttgtccgtttttatagttatttcttgattacatgctaaacaaggggtgaattattcatgagttttccagaaaggcatgggcaatttcccagaactgagggtttctcctgattttagaccacataaggtaactttctgacattgctatggcatgtgtacactgtcatggcactggtgggagtgtagcagtgaggacagtcagaggtgactctcatagccatcttggttttggtgggttttagccagcttctttactgcaagttgctttatcagcaatgtctttatgacctgtattttgttctcctacctcagcctgtgacttagaatgcctaaccatctgggaatgcagaccagtagatctcagctttattctacccagccccaatttaaaatggagttgctctggttcaaatgcctctgacagtttggcagcatctaaatgacatcagtttggaagtttgtaccccaagagtctacacgagggagcataaagtagttcaaagtgcctgctataatcctttccatgagatctaagagtaaagcctaaattgctggcctgtaccttacgcgagagccttcagggaagcatcagagtaaaacaaaaattatctggagatgacaaagacttatggttgtggtcaatttattactgtaattaatatcagaatgcaggaggatacaattcccattagagtatagagaataattatttcataagggtttgatcaatgtctcccaagagtaaggcaaatccccagaatcttcttataagaaatatactttctgaaatactcatgttcatattcataacattgtacctctacaaactcaagaggaggttaagcatctcttctaatttgacagcttttcccatggggctcttgcaatactgttgggctaatttaagaaatacatagcacataaaacaaaattttttttatgtttgtcttttcatacagtaagaaagtaaatctttgtgagtggttgggggcctttgggaaatttcaaaggtatttttcggtgtaaaagatatcatgacatttttattttattttttctaaatataggagctgatctttgcaaggcaaagtcgaaagggttgtcaggagatttggggcacttgattttgattagatcataagcacctgagaaacaactgcatggtgatctgtttaatcaatgtgacaagaaaatattttgaaataaacataaaagataatatgctcataaagaaccttagttctttcacatgtgagaaaagtttgttctctggatttttcttcaacaatcaaggacataataaagtcaaaataaagcacacacataaagcacagaaaatggttctggtaggcacaggttctctgctccccagacagatttcagagaagttaaagaataatctttcattctgtaaacgaaggcattaatcatcaaaccaaggaaataaacccatcaaaaatgaaccaacatttaagattttaatttactttatgccttcttttcagatttagttattaaaaaccaaggcaaataaaattcattttccaggtctcatattttactgagctctttcatagtgtggaacaaattgacttttatattaggataaaactactctcctttttcttacaaaacaaaggcatatgcccacctgcctttctctgtcatgacctctagtatagtctcaaccacagatactgattacagtttctcatcaaggtgaatatttcctatttcacagagaaaaatagagggtatatgattgagaagtgtcattctgcagcattttagcagaatagcacggctcatgaacacatttaacacagctttggacagtcacagccaccccttttacatcttcttaaagtggcaaaaatgacatttattaacatgatatagactcttcagcatgtagaattataaaacttaaaatcatgcttagacatcaagatttcagtattctgcattacttacacaatgtctagatatctaagaattacccattaattagcttaaattaatattagttcaagactttaaattacctaaagaccttggaaattacatttaaactagcacgctgaaaaacataattaccactgatagaaaagtttgttagaaaaatgattcaatttagttgaacacaaattacttttctcataatctttaaaactctgtaggagtattattagcttattttatctcaaaacctatataattttagaaagtttaggctatttttttcatgagaaaaacaacccaagtaaaataacatgtatatacagttaatatcaataattttgaaaccatgattattaaataaattgttcccatttgccaaatatatatattaattatgtgaacctagattcttaaaagttttcaacgtagcagtttgtgtaaaaataatttttaaagtatagcacatttttaaaagtctagcacttttaaagtattagaaatttgattttactactttaaagaaactctaagaatatttgatttacttaggtatgtattcatctctataagtaattagaacaaagctcttttaactgaagaaccataacaacctaatttattaatatctcctggaaatagggaagaaatcataccagtccaatgagggattacggcctttgtcagttacgtatacacaaacacacaaacatgaaaacatatacagaatttacagcttcagttctacagcaactgccccaggtcaaaataaacatagacacatacgaactccgtggtccagatttcaaagagctgttctccttcccagaaatttttaattggttggagctcaaaatagacaaacaaaatctaaaagaacccaacaaagaactgtgtctctcacccaacagagaagagaccattattgtccacctatagagatcaacaaattgaagataatagaaccatatttccaatccttgctgcctccaaggaggaataaattagtatccgtgtgagcaagaaacaaaaacaaaacacaaaatcagggaaaaggaagaaaataaagagaaaatcaaggttaaacttctacagccacttggaacttagactgagagccaagaaaagactcccccaggcttcggcagcccatgaggtgcacttgtcccataacagttgtcaagtaaatcctgtcgtctccctggggcttctaaactaatatagaataattttcaaatggtaaaattatgactgtcatacaaatataaaataaacaggggtgaacagttttactttcctcatgaattcatgaaaaaacgctgatatttaagcatttatgcccagaacatgcagctggaatggtgaaccatataattttgcacagcttccttaagtcatagctattggaactgtagaagtcaaagcagatggtggtgactccattatttaatctggttcacaaaacatcgtatctgtcacatgctctttgtaacatctaaggtaattacaaacatttattatttaaaatttgatttttataattgtcaaaatatattcaaaatttagttggctaaattggttgaatgatcaaactggacaaccatcattgtaccaggaggctgaaaccatgggctcagtctctcccactgacactgaccaactttgcactcaacactctggaaatccagcatctcattcataaaatgtaaaggtcaggatgcacactctttgagggcctttccagctccaaagtcgatggcaatgttgtcaatgaaagatcaacagatcagtgcattatacccagggtgcttgtacagttaaaaagtttctggcccccttcccagatacaccaaacagaatttgggtggaatccaggaatctgcattttaaataatatccatattattcttatacaaactaaagtttgaaaatcattagtatatggatgtttttcccctgaacaaaaaccagttatgactgaaaaatagttatcgagtttttctggtaagtggtacactactcagtgccttcaagtaaaggtgatctacattacaagttgtctaaaatgatgtttgaaaaggaaccaggttgtcaggttgtcactatttttaaagtggtggtttattatggtacatggttcattataccaactataagattttgagtatctgcttagttcaccagtgaacagctgtgaaccaatgtgtagattcttttacccattcctcttgcttttccctttcttctttcttagaagtggtttagagaaaacaaataaaaccaaaagctggttctttgaaaatataaataaacttggtaaatctttcactacactaaccaacaaaatgagagacaagacacaaattatcaatatcagaacttaaagaggggtcataactaccagtcctatggttagtaaaaggctaattaaaaataccagcaataatgttttacccacaaatctgataacttggtaagacagaccaattccttgaaaaacacaaataatcaaaattcatatgagaagtaatttgaataagcctgtgttattaaagaaattaaatcaacaagtaataaccttacaaaacagaaaggacctggctcagctggaattactggtgaattctaccaaacatttaaagaagaactaataccaatttttacaatgccttccaagaagatagaagtagagggaacatttcccaacttaatatgaggccagcattgccctaatatcaaaaccatgcaaagacattataagacaggaaatctgtagacgaacatttgtcatgtacacagacttaaaaaccctcaacagaatattagcaaataaaatacaaccaagtgtaagaagaattgtatacaactaagtgggaaatattacaggtatgcaaggctgtttcaacattcagacatcaatcattgtggtccaccatgtcaacaggctaaataagaaaaatcatataatcatatcaatggatgtagaaaaaccatttgacaggatctaacacccagtcatgatgaaaatcctcagtacacaaaaaggataaaggaagcttctcaacttgatttaaagccataccaagatgtcagtagctaacatcatacttacttgtgagaaacggaatgctttcctcttaagatcaggaaaaaagtaagatattgtctctcactatttctacacaacactatttctacaaaacattctagaaatcctaagtagtgcaatatgacaagcaagggttatacagattggaaagaaagaaaaccctcttcgtccaccgccataccagcctgaacgcacccgagctcgtcgatctccgaagctaagcagggttgggcctggttagtacttggatgggagaaaactgtcttcattcacaaatgatatgattatctatgcagaaaaccccctaagaatccacaaaataactcttggagctaataagagaataacaaggtcataggatataaggttaatacacaaaagattattgcttttatcttataaatggttgctctttcattgtggaaaaatgttcacccaaataaatgggccttgccactctgagaaggttgtgacccaactgaggagaaaatacatcttcctctgagaattaataagcctctgcaaggaatagcaaaacatattttttctttttattactttatctttctcattttttattttccttggagctgaacaggagggaagctagacaagaattaaaggtcaaatagcctaactagaggaaggtcttgatggttatacttcaagtcccagaaaaaaaaaaaaaagtacagttagatgatagaaaatggagatttatggttgctttacacaaataataaaataaaagacttaaatctttactccacttgaaaactccagaaggatagaagaaattgcattagtcttttgcaaaaatattttgataactttttcttacttatgtgttccatttgtcattttctctaaactacacctgccccaccttgaaatgtttttatctaggctttgaatgcctttgctcagttatccagcaggctatgatcctctgcgtctgctctctgccgatgtgtgagtgcatcaaatgcaagggttgcaagagtaattatgactctgttactgcacagctccgtaatcatgacaataaaacctggtaaaaatgctcagaccacatcttagcctggttccagacagtgttcatttctgaagctcacttttcttggctttctgtgtagctccactgacaagttttccaaacctttgaagtctggcaaaattcccaaaccccaggactcctcaggagagatgcagcagtggaagctgagctgactgcctttaggctgggtcatggcgtccccacgagccttgcaccacccaccatcacttccttgtcacttcagagccctcaacaagacaaaagggctcaccaaaaaaacacctcctctttattacaagaacatggaaaccttttttccagcctcacactggtaataataaaagaatatgctgtctaaagtctttctgtttttacctaggagatggaagccgctaagggtaggtcattagcctatcctgtaagcttttcactcttccacctccacatacaaccgcccctaaaataaaagacccctatgtagcaaaatacctgctcaaaggaatttctgcaaataaaggcacaaaacaggatattgtaccttttatatttttggtgagagtcaagggaccccagtctcggattattaaaattactaaacgtggttcatatcaccaagttcaaagggggtaaaaaggattaagcttcacagcattccacacgaaaatgtatcactggtaatgtgtcttttccaaccacaacaaagatgccacgtgggttgctacatggagaagtgttcaagtattgcgtgtcacaatatagacccggtaaattgtcttcggaactttcacttttccaaaatgggtttctgtgtgaaaatctgcaatgatctgaatcttttcccttgagtcctggtgtttaaaagatagcacaaaagctgctcagaaatctaggcttgacacctgctagctagaattcaaaaaggaaagagtggcaaagttcacaccacttgagaagaagatctctttcagaaatagccttgtggcaatggagagcaatctgcaatttgtaagagttccctgcctctaaacttacttaggaaattattccactgggatgagatttgcctaaattggaaacagaaagaattctctttggaaaattcctatcaaaaagaaaggaaaaaccatgtctcattgccatttccccataggattcttttctacaaacacacaccaagataacatatataagactccaagaagcccattcagagaaagaaatatatacaaaattgcaaaaacagaagataattactgaaaggacaagcataaattaactttttgcttttcctaaaataacatctatattgaaactttgtttacgcttaaccttcggagaattagttttgaaggatttttaattaaactgaagaagtagaatcaagaaagttgcaaaaaaaggggaagctgttagaaatattatgtatggccaggcacggtggctcacgcctgtaatcccaacactttgggaggccgaggcgggtggatcacaaggtcaagagatcgagaccatcctggtcaatatggtaaaactccatctctcccaaaaatacaaaaattagctgggcatagtggtgcgcgcctgtagtcccagctactcaggaggctgaggcaggagaattgcttgaacctgggaggcaggggttgcagtgagccgagattgcacccactgcactccagcttgggtgacagagcgagactccatctcaaaaaaaaaagaaaagaaaaattatgtatgagagaaaacagcaatgctagaatttgttctgtgactccatgaatgggaacaaggaaacataccacaggaagttattgtctacaaatgaaccagatgtgcagcaacatctgaaaacctgctctgccgtggggcactgtaggaagaaatgcaaaagcgagaatcggaagaacaaaggaatgagagggtagagccaagtgccgcaacccagcatccaaccaagaattagagacatcaaaaccccgggatggggccttagactctgccaggaacaaagaagtgggaaataaacgtaaaacaggccattttcaaatgaattgctgtgtgctcctaaccaatccaacagagcatcgtttagctagtaaaacaatatggaaaataaaagttaatgtttgtagaaattcagaaaggaaaataatgcaagaatctaattacttcccaacttagggaggataaaggagaagacacaaaagattgaagtgaaaattgaaatgacctcctatgcttttatccttcctagatttcaatgggcttgctattcaaaaataaattaaaaggttgtgtgtttaacagtcagactacagaaagacagactatttgaaatttataggagacaaacttgtgttttaaaaaataaaaggaaaaattcacaattgtttttccctaattctgggaaaggttatatcacttcttcatctgaaattttcaaaaagtgtatcaatatggcacttacttttctaccaccctatgtagcttcggatggtgtccgacacatctgtaacactcagttctataaaaacttctaagagcacttttaaatgttagcacttttaagattgaattaccctgggagtattgaggctttcagtattaaaataatttctggctagcattttcgagctgttcccaacatcttattaaatacctatagaaaccagctataaaactgaaattcacattttcagcaaactaagactcacagtcagtcagcttacagctcggatctaggaggaatttctaccagaaaatgacaaatctgagaagaattagaatgtgttcactaacaagtaggtcccttacacatagaagcatatatgtaaacattgtcacccttaaagacaggaaaacatcagctcattcacactctgtcctatagcagagaagcattttggatggaaaacaatttctctagatatatcaaacaagagaacatggcacaggatacagcaatttcagttctagaagccatgtctaaagaaagagcctgagattttgaccaaggtttatgtataaaattatttatggcacctgtttaaaaccaaatgaggaaactacaaaccacttgaaccaccactagcaagggaagagttaaataaatcatcacacagccaatgagactacttacataaactgtgaaacaaaaacacgaaaatatgctcacaatacaacatcaagtgataaaaagtagagcacaaatttaggatataaaatgtatttatagtatgaacccagttacgttaaaatcacacatatatacacacacacaaacacacacatctagaaaaaccctggaattcaataaatgagttagtagtggttgtctctaggaggcagaaacaaaacaacattaaaatttctctacactgagcagatggctcttctataataataaaaatagtacaaatattgttatttaaattaaaaaaatcaagtactcattgtgaggcttagaacaacattgaacttttactatcacttattcttgtcttaagagagacaaattaattgcttattcctgaacctcagataataacatatgccccctgggttgggatgggattcagtgaaataatttaatccaaataatatattttaagtgccaagtacaactctagcacaaattaggtatgaataaatgctggtcaaatctgtatacatacattggaagtagtcagtgatctgttcaaaaaaaaaaaaaatccacgaaacttcattccagatgagcaattcaattgctgcttctccacaggcatgggaagctcacacccacacagctgatctttagcgcccaccaccatctggaagatgccttccagtgcagtttgggactctccccttgatggataccagatggcacagaaagtcctaaagacatgcttcatactggtggcagaaacacaggcaagacacacagagatgaaaataatggaagacctaatgcaagaataaacgacccagtacctcattctatagcaagttctcacatcagtgcccctggaataactttagagcatattattaaaactgtgttttcatgtcccacaaggacatagactagattacccgaagacaaaagcatcaatgtgtcaaatgtgcatataggtggcctaaggcaatgagaaataggttttcatttcactttattaacattttatctgaattgcatttctctttgtctggtgctctgtgatcatactgggctgagttattcacagccaggatgctacttggccttccagatttattcttcattatctccaaataaaataattaaattgtatgcaggaatacagcacaaagccaaagatcttgtaatgcatttttaaaagtaaatcatcatccatgcagaaaagcaatataatggaatatttaaattttgccagtgaaaacctccaacaaacctagataatcctgaatctgtaggtgtttcatatttttaatgcagaaagatgtgaaataaatgtttacaaatgcttactttacattcaaaatcagtttctatgtgaagccaaaacatgtaggaaagaggggtctaaaatatttttaacaatttgaagctggctaaggattgagactaaaacagacttcaggccctttacagggaaacaaaacaaaaatgctggaagaaggtagcaggcagagtgatcaatacagaatggtggtgaagcaggattttctacatgcattcctgcctggggcagttctgagtaccccaaaggatcccagaggtcacctgggttggatgagtctcataaccccttataaggcaatgatcacggatcagtatctacccttcagcttttgtccccagtacacatctgtcaactgaatacaaggtaagggaggtgttccgaatgtgggccaaacagtgcactgtggtggttgatgtgtctttctctgtgcaggcctgagtttccattcctgggcaaccccatacagtggaggactgactcagactaatggccagcctctgaactacatgactgtggcagaggttaaagcatacagagagggagggaggtgtgactcagttatgaacctgtcatagccaggagctcacagaatcctctcttggtttcctccaccgccctggctgctcctcacttcctcattgatcactgatgctggcatgccttgggctccatcctatgctctcttctctcccatccatgcactcttctttcatgagtctaaacaacacctacacatggatggagcccaaatccatctctccagccatggcctctccagagcttcagggagtgcatctgactgcctacccaatggatccactgacatttctggaagacacctgtgatttaacataaagcctatcatttcctcctccaaatttgttcctttcatcgttcttcccatcttggcaaatggcatgccctcccccgcaatcccacgcatcatccaggccccaaatctaggatgcatccttcatttctctctctacgtcggtgctcatatgcaaaccatatcctgaccccacctgctccttgccagctctcctacttcctgacttgtctgagctgtccagatctcttgttcacacagtgagcctcgaagctggacccacattgccaactgttggatcctggctctgccacttactcactgagtcaaatctatgtggctcagttttctcatcagtaaaacagggaaaataatattcctgatctcctagggtcattgaagggcttcatcaaagtaaggctggcacccagcaagcactgcctcactgggtcttgatcctcagcaggcctcctgacccgtaaccacagtctgtttcctatgtgacagccagggtcacccattcaaaaccagatcaggtggggcgtggtgtctcacgcctgtactctcagcacgttgggaggccgagggtggtggatcacttgaggtcaggagtttgagcctggccaacatggtgaaaccctgtctgtactaaaactacaaaaactggctggcatggtggcgcacacctgtagtcccagatacttgggaagctgagacaggagaattgcttgaatccaggaggcagaggttgcagtgagctgagatcgtgccacagtactccagcctgggccacagagcgagactccgtctcaaaaaaaaaaaaaaaaaaagccagattacatcactccttcacttagaaccctgtactggattccctttttaatttgaatcaagcccccacactccttcctgaggccaacaggcatgatctctctcctgcccccaccctaactgcatctgctgtcaggagcctccttgtccattacccatccagcacgccatctgtccatccttacgttccccacacatgccaacacatccctctctggagactgtgcactctctctgtctggaatgttctacccgaagtctgcacatggctggcatcttcctgtccttcaggtctcagcccaggttcaccagctaaaagacacctgccttgggtcccagacactctctcacacatttgctctgtttcattgtattcacaaaatccctcatttccttctctcctccctaaagcctctcagttttgaatcccatgtcatcaaattgtatcacccattgaccttcatgaaactgtcaactcacactcaacatgtctagcaagtttgacttcctaggtcagcgctgctttcccatgaccactcctattctatccttggtcaccccatggcctcctggttccttaaacacttctcctccaccagtctcagccactgcatctttcctcctccttcgcctccttgctgacctccatcccctccttctccaactcccattccttgaacagtcactactgctttctttggccagtgccctcaaaactcttggcactcacactttgtcataattgcttggcaaatcagctaccctgaaatccagctctctaccaactgaatgtagcagagaaaacatgttgactaattgcttcttttttaaagaaactatttttatgggtacgtaataggtgtatatctttatggggtgcataagatattttgatataggcatacaatgcataataagcacatcaaggtaaatagggtatccatcaactcaaacatcatcttttctttgtattacaaatgatacaatcctcctttggttatttcaaaatatacaataaattattgttgactgtagtcaccctgttgtattatcaaatgctagatcttattcattctatctaattatatttttgtacccattaactagctccacttcccacgccctcatcactaccctttccagcctctggtaacaatcattctactctctgtttccatgacttcagttgttttaatttttagctctcataaataagtgagaacttatttgtctttctgtgcctggtttatttcacttaacataatgacctctagttccatttatgttgttgcaaatgacaggatctcattctttttttatggctgaatagtacaccattgcacatatgtaccatgttttctttatctattaatctgttgatggaaacaggttgcttgcaaatcttggctattgtgaacaatgctgcaataaacatggaagtgcagatatctcttttatatactgatttctttggggtatatacctagcagtgggattgctggattatataaaggttctatttatagtctagtgaagaacctccaaactgttctccataatggttgtactaatttacattctcactaacaatgtatgagggttccttttctccacatctttgccagaatttgttattgcctgtcttttggatataagccattttaactggagtaagataatatctcattatagttttgatttgcagttctctgatggtcagcgatgttgacccccttttcatacacctgtttatcacttgtatgtcttcttttgagaaatatctatttggatattttgcccatttttgaactggattgttagattttttttgtatagagttgtttgagctccttgtatattctggttactaatcccttgtcagatggatagtttgcaaatattttctcccattctatggattatctcttcagtttcttgattctttccttgtctgtgcagaagctttttaacttgatgtgatcccctttgtccatttctgctttgtttgcctgtgcttgtggagttttactcaagaaatctgtgccccaactccaatgtcctggagagtttccccaatgttttattgtagtaatttcatagtttgggtattaaatttaagtctttaatccattttagtttgattttttatatggcaagatggggtctagtattgttcttcttcagatggatattcagttttcccacatgtttattgaagagattatcctttcaccaatgtatgttcttggcacctttgtccaaaacgaggtcattgtaaatgtatgggtttgtttccaggttctctattctgtttaattggtctatgtgtctgtttttatgccagtaccatgctgccttggttactataactctgcaataatttgaaatcaagtgaagtaattcttccagttttgctccttttgctcaggataactggctatttggctattttgggtcttttgtggttccatataaattttaggattgttttttctatttctctgagaaatgtcattggtattttgatagggatggcattaaatctatagattactttggttagtatggacattttaacaatattgattcttccaaactgtaaaaatggaatatctttacactttttgtgtgtcctcttcaatttcttgcatcaattatagaaatatctcacttattttattacattaattcctaggtatttaatttcatttgtagctattgtaaatgtgattactttcttgatttcttttttggattgttcactgttggcatatagaaaaggtactcatttttgtatgttacttttgtatcctgcaactttactgcattggtttctcagttctaatagttttttggtggactcgttaggttttcccaaatataataatatctgcaaacaaggataatttggcttcttcctttccaatttggtttccctttctttctttctcttgtctgattgctctaattaggacttctagtactatgtggaataacagtggtgagaatgggcatccttgtcatgttgcagatcagaaaggaaaggcctccagcttttctccattcagtgtgaagctagctgtgcatttgtcgtatatggcttgcattgtgtgttgagttatgttcttctacatccaatttttgagggtatttatcatgaagggatgtttaattttataaactgttttttcagcatcagttgaaatgatcacatggtttttattcttcattctgttgatatgatgtatcacattgattgccagtgtgaatcaatctttgccagatctttgccagattttggcaaagttttttcagcatcagttgaaatgatcacgtggtttttattcttcattctgttgatatgatgtatcacactgattgatttgcatatgttaaaccatccttgcatccctgggataaatcatccttgattatgatgaattatcttgttaatgtgttgttgaatttgatttgctaatattttgctaagggttttgcatcaattttcatgggaatattggtctgtaggtttatttttctgatgtgtttttatctggttttggtatcagggtaaaagtggccttatagaatgagtttgaaagtattctttcctcctcttttttcagaatagtctgagtagtattggtatgaattatttaaatgtttgttaatattctgcagtgaaaccatcaggtccagggcttttctttgctgggagactttttattatggctcctatcttgttatttgttattagtctgttcaagttttgaatttcttcatggtacaatcttagtagattgtatgtgtccagcaatgtatctgtttctaggttttcccacttattggcatatagttgctcacagtagcctctaatgatcacttgaatttctgaagtgtcagttgtaatgtctcatttttcatctctggttttatttatttgggtcttctctttttttcttcatctggctaaaagtttgtcaattttgtttatctcttcaaaaaacaacttttaattttgtttatcttttttattgttctatttatttcaacttcatttatttctgctctgatctttattatttcttttattctactaattttgagttctatttgcccttgcttttctagtttttaagatgcaccattaggttgtttattcgaagtttttcttctttcctgatgtaggcacttacagctataaattttccctcttagtactgtttttgctatatcccataggttttggtacgttatattgccattatgatttgcttcaagacatttttcaatttccttcttaatttcttcattgacacactggccattctggagcatattgtttaatttccatgtgtttgtatagtttccaaagtttctcttgttattgatttgtagcattatgtcattgtggtcagagaagatgcttgatatcatttcaatttttttaatgttttaagacttgttttgtgaccttatatgtggtgtatccttgagaatgatctttgcgctgaggagaaggatgtgtattctgcagctgttggataaaatgttgggtaaatgtctactaggttcatttggtctatagtgtagattaagtccaatgtttctttgttgattttgtctggaagatctaatgctaaaagacaggtgttgaagtctccagctatgattgtattggggcctctctctctctttagttctaataatatttgctttatatagctgggtgttccagtgttgggtgcatatgtatttaaaattgttatatactcttatggattgacccctttattgttatatgatatcctttgtgtcttcttacagtttttgtcttaaagtctattttgtctgatataagtatagctacttctgctcttttttggtttctacttgcatggaatatctttttccatccctttattttcagtctatgtgttctttatagatgaagtgttttccttgtagacagtagggcattgggtattgtgtttttcatccattcagccactctttgcgttttgattagagtttagtccatttactaatgtcaccatgtaccaatgttattattgataagtaagaatatactcctgccactttgttatttttctggttgtcttgtggtcttcttttccttctttccttccttcatttcttttttttagtgaaggtgactttgtctggtggtgtgatttaatttcttgattttcattttttttgtgtgtatctgtcatatgttttttgatttgaggttaccatgaggcttgcaaatactatcttagaaccaactattttaagctaataacaacactgcataaacaaacaagcaaacaatcaaaaagtaataaaaatgctacactttaacttcatcctctctctttttaactttttttttgttctagttacacttactgtatgtaacgtctatttcttgaaaactgtttgtagcaatttattttgattggttaatcttgtagtctttatatttaagatatgagtagtttacacaccacaattacactgttacaatattctgtgtttttctgtgtatttactaatagcagtgagttttgtaccttcagatgatttcttattgctcattaacatccttttctttcagactgaagaactccctttggcatttctcacaggacaggtctggtgttgatgaaatccctcagcttttatctgtctgggaaagtctttctttctctttcatgcttgaagaatattttcactggatatattattctaggatataagatttttccttcagcactttaaatatgtcatgccactctctcctggcttgtatgatttccactagaaagtcggctgccaaatgtattagagctgtattaaatgttatttattttctcctgctgctttaggatactttctttacccttgacttttgagtgcttgctaattaaatgtcttgatgtagtcttctttgggttaaatctgcttgatgttctatagccttcttgtacttgaatgttgatatatttctgtacatttgcaaaattttctgttattaccctgttgaacaaaactttctacccctatctctttttccacctcctctttaagaccactaactcctagatttgcctttggaggttattttctaaatctttcaggcatgctgcattctttcttactctgctttcttttgtcttctctgactgtgtattttcaaatagcctgtcttcaagttcacctaattgtttcttccatttgatcaagtctactgttaagagactcaggcatccttcggatgtcaattgcaattttcaactccagaatttctgcttgattctttgtaattatttcagtctctttgttaggtttatccgatggaattctgaattcctctgctgtgttatcttgagttccattgagtttcctcaaaacagctattttgaattctctgtctgaaagatcacataatctgtttctccatgattgatcactgataaccttattaagttcgtttagtgagatcacgttttcctggaaggtcttgatgtttgtggatgtttgtcaatgtctgggcattcaagagcttggcatttattgtagtcctgacaacccgcatttgtttgtactcattgttcttgggaaggctttccagagatttgaaggcacttgggtgttatgatctaagcttttggtcatgtagccatatctgcattagggggcaccccaagcctaataacgttgtggttcttgcagactcatagaggtactgcctttgtggtcttggataagatccagaataattctctggattaccaggcggagactcttgttcttttccctaacttccaccagacaaagtctctctctgtgctgagctgcctgaagctgggaaaggtgacacaggcacctctgtggccaccaccagtgggagtgtgctgggtcagacctgaggccaccacagtgcttggtctcacctaggactggtgtaaccactgcccagctaccaccaatattcactcaaggccctagggctctacaatcagcagctgcaaaagcaagcttaggcttctgtccttccctttagggtggcaagatcacctcagtctcaggcaggtccagagatgtcattcaggagccagggcctggagtcagaaaccttaggaatctactcagtactctgttctaccatggctgagctggcacctaaaccaaaagacaaagtctttcccactcctgccctcccctttctgcacacaaaggactctccctgtgtccaccgccatcccaggcctgtggtgaatattgcctggctactgccaatgttcactcaaggctaagggctctttagtcagcttgtggtgaatgctgtcaggcctgggactcttccttcaggacagtgggctccttgctggcccagggcagtccagaaatgctgtctgagagccaacttctggaactggggaccctgagatcctacttggtgctccatcccactgtggctgagctggtggtacctgaggtgcaagacaatgtctccattactcttcactctcctttttcaagcaggagtctcttccatagacatcacagctggaaatgtgctgagtcatatctgaagccaggatgtttctgagtctcacccagggcccacagtgagtactgtctgggggctgctgttgattattcagggctcaagggctctctctctctagtcagcaggtgatgaatcctgccaggactgggttcttcccttcaaggcagtgggttcccttctggcccagggtatatctagaaattttgcccagaagccagggcctggaatgggggcctcaggactctgttgggtgccccatcctactgtggctgagctgatatccaagttgcaagacaaagtcctctttactctcccctctcctcacctcaagaaaaaaataaataaaaaggaatctctcccagaggtttgagctgagctgcctggagttggggtagggaggggtggcacaagcgctcccttggctgccccagctggtgtctccctaggttgcatgcttcccaagtccactgactgtgagccctggacttgcccaggatttgcagttctggtgacccagactgcctttcaggttgattcagaaccccagaacactttagcccatggtggcaaggcttgttggaactcgggttctcaccactgggataggtgattcccctctggctagggctggtctaactgctccctctgtggacacaggctgagttctgcccagttttgctttccactgtgacagggcagcactgtgttccaatgcaaagtcctgtagtcactgcactctccctcccccaagtgcatggattctctctccatgccacatgcccactgccaggtaataggggagggatggtgtcagcaattcaaaactgtctttcctaccctcttcagtgcctccttcagtgacgtgaaattaaaaagaggtagtgtgatcgctcctgtgacttttggtttttatgaaggtgcttttttgtgtggacagttgtttctatccagagtaatttggtgtttctgcagggaggatgatcagtggaggcttccattcacccatcttctcctgcctcctctcctaatcacctcttaaattcatgaggagattcaagtgggcctttagtgaggtcaggcacaaccacccatgaagccctgttttactcactttcccattcctcctagatgactatttcacctgactttcagcttaatgacgtggcttcctgcttgacgtggaaagtggaagcactcagaggaagatggccagactccccacaccacattttccttcttacagtcgtctatgttgacacattctgccttccatctacaggcattccttggagatattgcaggttcagttccagaccaccacaataaaacaaatgtcccaataaagtgagtcatatgaattttctgctttccaagtgcatatagaaattatgtttgcactataatgtagtctattaagtgtgcaataacatatgtttaaaaaatgtacatacagtaattaaaaatacttttttgataaaaaatgctaacgatcatctgagccttcagcaagttgtaatctttttgctggtgaagggtcttgcttctatgttgatggctgttgattgatcatgagggtggttgctgaaggctgggctggctgtggaaatttcttaaaatgagacaacagtgaagtttgctgcatcgattgactctctctttcatgaaagatttctctgaagcatgcaatactgtttgataacattttacccagagaacctctttcaaaattggaatcaatcccctcaaaccctgctactgctttatcaaataagtttatgcaatattctaagtcttttgtggttgtttcaataatagtcacagcatctttgccaggagtagattccctctcaagagaccactttctgtgctcattcgtaagaagcagctcctcaactgctaaagtttgatcatgacattgaagcaattcagtcgcatcttcgggctccacttcgaattccagttctcccactattttcaccatatctgccattacttccttcgctgaagccttgaatccctcaaagtcatccatgagttttggaatcaacttcaaaactccagttaatgttgatactttaacctctttccatgaatcacaagtgttcttaatgacatctagatgggtgaatcctttccagaaggcttcgaatttgctttgcccagatccatcacagtaatcactatctatagcagctatagccttatgaaaacatttcttaaataataagacttgaaagtcaaaattaccctttgatccatgggctgcagattgatgctgtgttagcaggcatgaagacattagtctccttgtacatctccacatctccatcagagcttttgggaggccaggtgttttttttttttttgagacggagtcttgctctgtcgcccaggccggactgcggactgcagtggcgcaatctcggctcactgcaagctccgcttcccgggttcacgccattctcctgcctcagcctcctgagtagctgggactacaggcgcccgccaccgcgcccggctaattttttgtatttttagtagagacagggtttcaccttgttagccaggatggtttcgatctcctgacctcatgatccacctgcctcggcctcccaaagtgctgggattacaggcgtgagccaccacgcccggcgggaggccaggtgttttgctggtgagtagtaatattctgaaaaaagtttctttttttcctaaacagtagatctcgatggtgggcttaaaatattcaataaaccatgttgtaaacagatgtgctgtcattcaggctttgttgtttcatttacagagcaggcagagtagatttagcataattgttaagggccctaggatttcaaaatggtaaatgagccctggcttcaacttaaagttaccagctgcattagcccctaacaagataatcaatctgtctcccaaagctttgaagccaggaattgtcttctctctagcttggaaagtcctagatggcatcttcttccaatacaaggttgttttgtctacattgacaatcgattatttagttcagtgacattcataacttgtcttagctaaatcttctagataactttctgcaccttctatgccagcacttgctgcctcaccttgcacttttatgttatggagatggcttacttcctcaagcctcatgaatcaacctcttctagcttccaacttttctcctgtagttttctcacctctctcaaaagaaagttagggccttgctctggattaggctttggcttaaggggctgttgttgctgatttgatcttctagccagactgctaaaactttctccatgtcagcaataaggcccttttgctttcttatcattcgtgtgttcacgggagtggcacttttaatgtcctccaagaaatcttccttcgcattcacagcttggctgtttggcacaagagacttagctttcagcctgttttggctttcaacatgccttcctgagatggtttggatgttttttcccctgcaaatatcatgttgaaatgtgacctgcagtgttggagatgggacctggtgagaggtgtttgggccatggtggcatatctctcatgaatggcttggtgccgtcctcgcagtaatgatttagttctcactacaagttcatgtgagatccaattgtttaaaagagtctggacctccttcctctctcccttgctccatctcttgtcatgtgacatgcctgctcctgcttagccttccaccgtgagtaaaagcttcctgagacctcaccagaaggggagtacatgccagtgtcatgcttcctatacaacctgcaaaactgtgaaccaattaaatctcatcgttataaattactcagtgtcaggtattcctttatagcaacaaaaacagaataacacacttcctcaccaagtttaaccatttctagcttttgctttacagtgagagatgtcaactcttcctgtcacttgaacacttagggctattaactggcctattttcaatattattctgtatcatgtaatagggaggcaagaggagaggaagagagatggggaaacagctggtcagtggagaaatcagaacacacacatttattgcttacatttgatgtcttatatgcatgcagtttgtgatgcttccaaacaattatgatagtaacatcaaagatcactcactgatcacagatcatcataacagatataataataatgaaaaagtctgaaacattgcaagagttaccaaaatgttacacagagacctgaagtgagtatatattgctgggaaacagcatagatagtcttgttggatgcaaggctgtcgcaaatcttcaatttgtaaataacccattacctgcaaagtgcagtaaagagaagcacaataaaatgagatatgcctgtacttaccctcagctgacttctgatgcacactagagtttaacaattcaacaaacactgctagagatgaacccacttttctgtgaaaggccaatctttctgtgtgccacataccctgtgacctgttcaaagacattgtccagcacggccccttttctctcctgcaccatcagttttccccctttctacaagatcatttcctttgacatagaagactgctgttaatcatctcatctcatggaaaagaacatcaccccctcccactctgacagttacctgacctgcagctctctgcccctgtacagcaattctcctgggaagagatttctttgctggactcttctttgcttaacttctcttctggaattatttcctgaactcattttcctcatgttccatcaccagccctccactgcactgaaaggttccctactacagttacacaggacctttgtgtcacaaaatccagaggtcaattctgattcagattcctttggctaactggtcatcagctgcatttgacagagctgggaccccctacccactaatggacattgctaattctataagtgtcctggctacctcacttgttgcttcttctccatctccacgtctttctgcatcaacattaagaagtcaggagaaggggctcttccttcttccgtaatgattatactcttttggtaaattcaaccaaattcatagcttcaattctatctgtaccagtcaagattctccagacaaatggaactaacagaatgtgtgtgtgtgtgtgtgcgcgcgcgcgcgcatgcacgcacatgtgcgttcatgttaggttatagtacagttatttaatcaaacactaatctaggtatttttgtaaatgtggttaacatctataatcttgttaacttcaagttaaaaagaataccctcaactctgtgaggaataggcctcatgcaagtagttgcaggtcttaagagcgaaaactgaggtttcccagaaaacaatgaattctgcttcaagactgcagcatcaactccctcctgagtttctagtccaccagcttgcctatgcatttcaaacttgccagctcccacaattgtgtgagccaatttcttaaagtaaatctcttaatgcgtaatatattttatgtaggatatatatcctatagcctagccaagttgacacataaaactaaccatcaaatgatccatgtaccatgaccctgattcatattttcagtccaaattgttttgtgtatccacttgcttactcaatatctccacttgggtaacaacacaatttttaaagttgaactttacctgcagactttttgctctcatttggtggcaacttgatccttcctgtcctgcagtctgaaaatgttagaatcatccttggctcctctcattcacaccctgcattcaaatcctgctggctccgacatctcacagcctccactgctcccacatttgtccccagcaccatgtctcacctggactgctgcaatggcctccagagctgcttctgcccttgtgtgctggggtctgattgcaacacagcaacccaagcgactctcctaatctgtaactgagacaagctatttcttcacactagaccacaccacttctccactgagtaaaaggcacagtccctgcccaggaggcctccagagatctgtccccttttcctcactgacttaaattccccactctgctgtatgtgtaaaccactctgacaacactgtcctccctgtgttcccaaaagacaacagacacactctgctccagtgcttggaccctagaatactccctctgcctgggatctgcttctcccagatgcccacatgctcactctgcctacttcaaggaacttgaataatgcccttctcagcaaggccccctgcatgtgccatttgaacctgcagcctctccatccatcatccctgcctatcctcaccctgctctgacttgtccttgtgtttggagccttctcacctttacccctactattccattgactcattacatttattgtctggtctttcttccccattaaaatggggatagatgtctttctggttttttacactgatgtttctcaagcacatagaatagcatctggctcaagcgggtcctcaataaatatttgtggaataaatgagtcatttgtgaatatatcttgatgtgctattccttctcacttgaacattacagtggaagctccatggagacaagggcttgcctctcttactcaggcccctccagcagtccatgcacagggcaggcctggcaaatacttgttggggacttctgaccaatgaaggtctttggagatgaaagagaggccaattcctacaagttacaggatctcatagtcctcttttcccaaggttcactgtgctgggatttgcaggtttctggaagattttgaagtgagcactctacttttaaagccacagtatccagtttactgatgaactccactctgccttttccccttcaaaacctgatgcccttaccaagctgatttcccctgggtgggcatcctgatgggtggggcggggcggggctgggggggtcccacccacatattaagccctgacttgctggaactggtctgaacatttgtgcctcagggcaagtcaaagcaagacccctttgcaccaagccaggcattgttttagaactctgactccagcactgcatggtctccagctgcagggaccttgtctttacatcactgatgggcgcattaaccacaaactaagagtcgtgcatgcaagaatttcaacctacctcatctgtagcttaaaaacacttttaaaggcaatacatcttttcttttctttctaaagggactaaatgttgccttgtccagtggaaaaaaaaaatctacttataaaaagcattctttgggggaaagagggagtgattcttatctgaaaaccaatggagcaaaaggactaacattttacaagcttcagtaaaacccaggaaaacctctcagaatgaggatagctagggaggacagaaacccacgagctagagggaggtcaaagtcctggctctttagtgggtgttgctgaagttgacaaatagcaggcatttgtgtggtttgcagacatcgctgtccttgcctccccatggctgcagaaggggcgtgtctcctgtcttcatcaaatctctgcagccccgttgccttctccttgccttactctattggcttttgaatacttcattaacttttaaatccagccatttaaatgcttgcatagcctagttcccctttacctaaaagaatcattacaacattgtctctctcctcatatacttaaatcatctcactcaggcatctgcaaagataatctcaacgattctacttaaactccttagctattaagaaaggcagtaacatcaacaggctgagctggcccttgaaatgggagaagctcctaacagcatctggtcagcttagctgatgcaattgcaaggctggcctggagaaggccccatccagagactcctccctgcagaaccagatggcttcaagaatatgtgcatccgtgctgggccctgggagctggggttctacttaaacacctttggacctgctgggacgtccttccttgagtgtaagcccagtttctcaagcccatatcctcttcttttgattacaacattgtaaattattaaataaaattttcatactgatttcctttagagtaaaagaattttgtgcttttttaatggaataagaatatttcaatctttctttcttttctcttggttatttctagtgctttaaaatgtgaacaccaaaactatttttttattataacagaaaagccaaaatattgtttaaaatatgtgtagccaagacaaatcttattatacatgctcatatcttggaagaacttgtgcacagttaatgggttgatgagtgaagcattcaagacagggagttgctcagcactggagtgtccagaggtcttgaaggtcctggttaggagcccagtctccagagctgcgctacctggattcacatcccagctgcatctcttcctggctgtatgaccttggacaaatgacttaacctctctgtgcttcagttttccacagtaaaataagtatgagaacactacctagggcatcaggatgtgaagtttaaataagttaataaacttaaagaacacaggatggtactgaccattgcatgccatgtaagggtttactatgaacattagctcttaatgctctataattgaatataattttgatttggaatatctatctaaccaggctagcaggagtctttcttctgtctctggggtgtcctgtggagagggaaaatcccccaaatccccaggctgggaccaggccaaggtctgtccacagaggacactactgagagcccttgggctctcatacatccaggactcaccacaactgctgggtctccctgaggtccatatgccagaaaatacttctcaagtacctgctcatgtgtgctatccccagcagctggcatgaggcctgagagtgtgcccagcacactggcagagaacattcaatgtaggcaaaggaaaaagaacagacagcctgggaggatagcacagggtttcaaccttatgcataagaatcatgaaaaggtctcatcgtcaaaccgccagcctgcccctgaaaagcaggccagagtaaaaaggttcagagctcacaaaagaaatgtattgcctctcagtcctggaggctgaaagtccaaaatcagggtgtccgcagggccccgctccctcagaagctccagaggaggatccttccttgcatcttcccagcatcagtggctgccaccaatccttgggtttccctggctggtggcagcatcactcgaagccctgtgtgtctctgtctttgcatggccatcttcatataaggacactgttcagattagattaggggtccaccctactctagtatgacctcatctcaacttaactaattacatgtgcaggaagactgtttataaataacatcctactctgagatcctgggggttaggacttcaacatatcatttttggggagacacaattcaacccagaacagtatcccatgttaaattaaaggggctatatatttttcagcaaaaaagaggaatgcatctcttcataaagacatagacatataattttactggaatgaaaccttatcttacatgcccttttcaccatggctacagctccccactctctcatctccccacagccaggtgagttctgttgccatttgttgctatgtgtatccttccatatgcttctatttactcaaatgagcctacacacacctatgtaggcagatactcattgtgtaaatatgcatcttcaggggaggtttttgtcacggttttacaaaaatagaatcaatcatttcaagtgccttttgtaaattttgcttttatcacacaataacatctgggggaagtcctgccaagccatcttccaaggctctaaagcattatctttaatgattgtattatgtattctgcagtgtgggcattagccaaaaattaacagtgattatcttaagacacttgggggtagggtctctcttcctttatctttgtggagatttgatagctgttcaataaatatgagtatgtttgaattgaagctgaaacatttttcaaaaatctcaactctgatagcattgatgccatttatacaattttattccttcttgaggacactgacattttagggtcccagagactatgtttaacattccctataaaccatcacatttatttatcttaccagcccaaggaggttaaagtctccatctaaagacagggcaggaggttcagagacctgggcacacagcgtagtgggcagactgaggactcaaaccctgaactaacaacctcccacacccatcactctctgccatattaggtttcaaaagttacacatcatctcatatgctagacttggctctggaaatctagttttggttgttcccaaacccaccctccaaagttatatgaccactgaaaatatacaaagtaatgaagcagagccaaaaagtaaacaaaaaagttttagcaatccatgacccctgctgctctgcagagaactgtcctaattttcctttgcttatttaaaatcagtgacttgacttcagtcacatatgttacacatacataatctagtttctagaagcagaatagaaacacttactcatacacgactgggcaggatgtcattaggaaaaggtgaaggaggtgacaatttggggttccaggccctgagttgagggaggacagtggtgacctattaaactagacaatggctaagattgtcatgcttgtttgctgtctctgagagcatatttcctaggaaagatgtttaggagtatttgacaaagacccatatgaaagttccttcacagcatattttacctctaactgtctatgaattcatgtgtgactttgatatagatgctgtaaactttggtacacaaagtaactaagtcccatcacagtatggaagggatgtgaatttcaaaggtgagtaagtggtgcctagaatttacctttcttaccttcctgaaatagcacgtacaataacacggttctcaacgtgggctgagtattctaaacacctaggaactaaaaagtttaaaagtgctgacacctgtatttcaatgaattgatttaattagtataggatgtagctgagcatcgagattccataaactcttcaaatgactcgaatatgcagcagaagttgagacccacagccctaggagatttgaggggaaagcattaaaattgttaaaaattagaaggactgtttgtgaaataagataaaattaaggagaaataacctcctttactgagcaatgtagccttctatgagctgcccccaaccttgctcttcagtcccaccttccattcttccccacattttttgttgtagctgaaacatactttctctgcataagccacatcattcttctcctcttatgctttgtaaatattttcccctctcccaggaatctttctctaaatgaatcctgcactttcttggtgattccatctaagtggtctatttggacagaacttcagtggactcactgcatttccctcaactatatgttttggcccaagtttctccacttgacctcagtgaacaccaaagagacagagatgttgcgccatgcattcccatcacctagccaggtgactagcacatcatagacagtcaacaaatggctgtggggtgaagtcaggaagcaaaacagcattaggaagtatgtatcagcttctcaccaattgtagtattgagaaatttatcatcttgacaggcataaacatgtaagagaaaatttgctttgcaaattatagcacccaaaagcttaaaagaaaacatcatgaaaaagacaggtaaaattgaactcattccatctaatatggtgtttaaaaatgtgtctccattttttctttgtacttattatcaaaaaccaggtattgcaaaagtatattagtaatcacattattcttttttcagtctgatggaaatacaagatacaagtggtcctacagaagaactcttccctttggaagactgaaatgcctggtaacacatggctgcaaatgtttgctgatctctctaatcaatcccctgcaagctcactagccaagtggcagtgacactttggaaatatcagaacctggtaatttatttcttgactgtcttcccaaacaattaaggacctaacatctgcgtgctaagcaaccatgggctactcctttccagcaactttgcaagaaacactgtcagaactccttaaaaacaatcaactctgaaaaagaggaccccagagagtgtctgcacttgagtgaatgttgcccaagcaagggcaaacttctgccacatacagcacatgtttttaaagatgaagttcttgtccagggtgtctggcaattgtgtggcactttgaattagactttgcagaatgacagcaatttgaccaacagcgtctgaggggcagatgctttctgcacactctcaagctcaatgtggcacaatccaggcgattttgcaatgctggatgcatggtgagcctgctgggctgtcaacagccgcacaaagtgaggttgtgccagaatcatggggtgttcagcattcaaagagaactcagatatcacctcattcagccccttcacagtacagataaatggagagagaccagagagcttaatgatttcttgttgaaggatcacacatagaaaggtatatgtgtgttcaatccaaatttgcaggcttaaattcgagttctctgcctgcctaatctaaattggctatttgcactgtccaaacacaccagttgatattctgaacttcctttgactttccacccgataagcagcttaaggatgactgactgtattgacttgcccaagtcaagctggggctgcacggatggtctctatccattgcttctgctgtgcatggctaatacagctcccagccaccgggtaatccttgctagcatccagttattttgctgtcactcaccacctctgggcaatctttatctctgacctaaaaacccgtgagagctaattcctagaatttaaagaatttccaacaggtatgtgagagtagaagcatttctactaagatctttgtctcttaaaaaaaataaaataaaaaaggagcagatagccacaaagaaacaagaaaatataattatgggtctatttgtcttgcctttcatctcagagagaaatgtggcatcttgtagagcatgtgggttgatttcagccgaacaacagtaaactcattagaagctacaagatggggtattttagaaaagaatacagagtggaggttgtaagtgaaatatgaaaatgtttttattctaaaactagaataaattttctatgtaaattttcttcatgacacagagataaaattaagtgaaaaacaaaaatagaagaatggtctctaatttttgcctccccaccacaaaaacaggggctatgcaaggacaatgtatgcatttatacacatgcctatgagccatgagtctccattttcttgtttgtatcatggtttcacaaagataatacctgtctcctcctacttaacaacctctaaagcaaatacaacaaaaatgagctagtagacaccattcccatgcctacccccaagtaacttatccagctttgaaagaattaccatccaaaggaggaaaacgggcatcaacccaggagcctgggaaaggtatttgatacaaagcatcaaatctgccaggcatttgatactaagtaatgacttcaaaagcaaggtgaccagaggaagctttagatcttcctctgcaggaacagtttgacttttgctttaaacctggcacaatttaatctttatttgaaggatatacatacagagtcattttcttcattaagctgccttgacgtgcgcagatccttcgacagatttaaatcaacatgcttgaaaaatgggcacaaataatttggcatgtgaaacgggataggatcttctccaataaaacatggaacttcaacgtggagccaattacaacgttgcatagattctaagacatcaccaattgtaaggcagattttcatttttcaaatgactgagaaaaaatgtgtgaattaaggtatagcaggatccctccatgacagcctgtgtaccagatgcatgaatcgatcacaccagtctctccttagtttaaatgtctttatcctgctgtgtggatctggcaatttctcctgccttcagcagcattggtggttgtgtgctaggcaattcttctccacacatctcagtagtcatttgtgtccacctacttcttttcttgggtttggtaagttatgctgtggcaacaaacaccatccaaatcccagggatttacagcaacaagtatattgcaacaagtatattggctgtggttctgcttcgtaagtcctgcagtccagaataaaagaacagcccctactggggacatgccatcctcatggcagaaggccaagaggaactgcagaagagtgtgatggctcctaaggcctctgcccagaagaaacatatatcactctgctcatgttctttgccaaagaaatcacatggtcaggcacaacattatcaggatgtgaagtatgctcctctcacatgcaatgcacaaaggacaggccctggagggagggatccagtacagaggggcagtgaatgttttcaacaaatgttacaatctaccattaagccttcgatggtcactttgcaaggaaatagagaatgtggttattctgacaaagagcagtatttgctccactgataacacattttataccctgccactctgttttcatgcctttttgtgtatttaataatttttactttaaatgccaaaaatatgtaaattttggagataatttaaacatcaattaaactcaaccatatagttagcaacaacatacatgactcaactgaagccacatcggtgtagcaactggggccgagtctacccaaacacaggcaatgccaactgtgtcacggctgtttcccgtcaacggcaagcataaatcatcatcatttgtaagatgcatctcacttgcacatgtgttgaaatgtaaaaaaagaaaaaaagtatcgtacaattaaatacagcattgtgtgtgtctgtgtgtgcatgtgtgtgtgtaaaataagaatttttttttcttttttgagacagtctcaccctgtcgcccaggctgcagtgcagtggtgtaatctcggctcattgcaacctccgcctcccaggttcaagcaattcttccgcctcagcctcctgagtagctggcattacagtcactcgctaccacgcctggctaatttttttttgtatttttagtagagttttttagtggggttttgccacattggccaggctggtcttaaactcttgatctcaagtgatccacccacttctgcctctcaaagtgctgggattacaggcatgtgccactgtgcctggcctataaaataatatttgtttatcagctcttaaatgctctgcattcttgctctttggagcatggtctgtggcccagcactatggatgtcttccaggggctggttaccagtgaaaaatcttgagccccaaccaagactcttgactaagaatattaacaagatctatgagtgaaccatatgctcactaagttagataagcagtattctaaatgacattagtcttatagctgtgaagtgcattatagtggagtgaacacacacacacatacacacacacacacggatcatgggtatgatgagatgactctgctcagaatcctcccttgcagccttggccccagcatgtacagtgagagagaagagcatctcagggttatcccattcagcaggacgagtgcaatgacaaggacagatcaggtatctccaaccctggctgtgcattaacatcacctggcaaagtttttaaaaatgctgaaaccggaccgggtgcagtggctcatgcctgtggtcccggcactttgggaggccaaggtaggtgaatcacttgaggccaggagttcgagaccaacctgggcaacacagtgaaaccccatctctactaaaaatacaaaaattggccaggcatcatggcgcatacctgtgattctggctgcacaacaggctgaggcaagagaattgcttgaacccaggaggtggaggttgcagtgagctgagatcatgccactgcactccagcctgggcaatgaagcaagactccatctaaaaaaagaaagaaaagaaaagaagaaaaatactgatacctaggccctgtcctccaagattcatttggtttagggtacctgtgtttttagatacttccccacatgactctgttgtacagcctgggtgtggggcttccaatgtagaggacgcatgcagatagaaggtccatttgtgaactagaaacagagctatctgagctctcctgtgagcagccgaatcttcttcaccgtcaagatcactgtataaataatatattctcatgtagggggcaggaaagagaacgagatgtgttggatagagtttagtgccaccaggagtcaggattcaagtgggataacaaggacttcggatttgatttgattgcagatccatgtgtcatgtctaatacacattcaatgtagggaaaccacacaaatttgaagtcccaagacctggatctggaacttttttctactgatcatcttttttttacccttgaataacccacctatgctccccaaggctcactttcaaataggtgttcatatcacagaaacacacacatatatgcatgtaaatgcatgaacattcacattcacatatagcaatttttaaaacataatgaacctctgctattttccaagacttttaggttgtcatggtcataaatacagaatgaacccatctgttctatctggtagcctatagatataaacctgggattgatgacatgattactgggagaagtaggctttcttcccgtgttataactttgaaatgtctgacctatcttgcactaggttacaaacactggcaacgatcaacccgacttttgaagtggaaaaattacttgcacggcagctattgacaacacgactttcattccaaaaggatataaaactcaaaagtgagtgtgaatgctggtgatcccatatttctttgctcaggtgtcaatgctatatccctgggaagttcccaaatgactactcctgcttgacgacttaggaggaaacatggcagcgatcattaatctcatggggaaagtggtatgtatgatgaaaaaagatctatatatgaatctttacttctactttgggatataaaaaataggactcactgagaagaagaacatgaaggcctctatatgatctttcttcctccactcagttctgcttttcatctttaaactggtgatattctgatcaaaatgttcattctatcccaaatccaagcatattctcttgaaagtgaaggggatcccacaattaaaagcaaaaatgccaacatctcaccactgtgctaatagggatgattccattgcatataaaagatgcattttcttagaaagaatcttcatgaaacagactttgctcaagtccacctatacatagagcatgaaggtgatcaagagactcttccaggagtttcttctaacacatccagcaaaacacggtcctaaaatggcaggactggaaaaaagagctactcaaaatacatgaggtacttgttttctttgtgggctttttgttcctggagggggaggaattaggaggggaaagggcataggaaatgatgcagacatattgtataaattaggaatggcctaagctaattgaagataaaagggaataaaacacacatgttagggaagtttggtttcaaaacaactcaatactacctatgctgttatgggataatgagcaaaaggtagttctttcaactcaggtaactaagaaagagaaaactaaactttgatcactatagaggaaaccaaatacagtaaatgggaaaaccttagggacagatggagaaggacagtattaagtttgtgggggtgtcataagataggaggccttggaagacacaataaaatcagctcagatgcccatatgcacactcaatgcaggtgctccgctgcagttctcagtcaaggaccaggcctgcagtctggggtggtgagtccttcagcattggatgtggtgtgtggtcaggcagaacagaaaccagatgcagccctggggtgcggggtctcattcagtcaagtcagggaatgagaagctgtgaattattaggctgctgcttttgaaaagtggatagggagacaacataaaacaccaggaggcatggacagtgaggcctggagaagtgctggcaccctgcaagctgatcattctgggtgtggtacccagaccctgtgtctcggtccagaaccacactccagagctgagcctcagatgaaagttggcccttcctgaaggattcagaaacattgtactcaggaagatacagaaaacttcagaaataatgaagcaaaactaacccacagaattaatactttgtgttgaatttaggaatgaactgtgtaaccaggatttgtgtaaccagggttttgtgtcaccaggattttttaaaatcttgtaaccaggatttttaaaaatctctgggtcatttaagtcatttgaaacatctctgttattccagcatattagagcatgggactttttggccttgggttttaaaattttttagttgattctagacttgtggtttgaatttgaaagaaataagatttaagtttgcaaagagtctttgaagttcaagagaacttgattgatttattatatttataagagctgggtaagtgatttgaaggaattggtttattgtaagtctatcctgttagggatataaaaggattcagatatattaaatttataaaatattttttaaatgcttatgggaatttaactacttcagtttacacgtttgagtgcttaagtgaattgtatttgttcaattgatgagttaatcaacaaatattaataaacaaatataagtgatcattcttattttacacaaaaattactaaatttattatttaaaacaaagtttgtcactttaacaggttaagaaaaaattaattttcaacttaaaaattgagcctctatttaaacaattaccctaagtaaacttttctgagaaaatatctttactaaaatgttttttcttaagtcttaactgttatatacctcatacgaattcagaaaggggtcacattttgctttgaaacataagtatggttgttctgttttccttattaaccatttgaagggagaaaaaattatcccaatattgcagctaagtttagagtcctgctgtggagatacagcctttcttggtagaatgtcaaacttgaatccattcaacctacacacattaataatataataatgataatttcagtatttgggtttatctttcacttttgcaaagaataactgtacatattcatgaagtacatagtgatgttttaatacatataatgtatggtgatcagatcagggtaactggcacatccatcatctcaagcccttattatttctttttgtggggggacagatattcaacgtcctctttctagctatttgaaactgtatcatatagtcaactgtagtcaccctacagtggtacagaacactggaacttactctggccatcggcttctctaatcagcgttttctacaaagcaaccagaggcaatttatgattctttctatctacttgaaacctggagacacatgcaccttactaacatcatgatgaagtgtccttggacttgactgctaagactattccatttctaggagactttttccccttggggctagaggacaaagtaatatcttcaaaagctaaaagctcttgaacacaaaaagggcccagcaccatgtctagcacataacaggtgtgcaacataccagggtttccctattctcagctcttttacttcaagccttaattgccttctacctccaagaaaaaaaaaagaaaagtagccaggtctaggagtcaggatgccattggaggtttcggataatgtcttgaggactcagaagatgaagctgctatagggcataatttccctttcctggtcacacttggccccatccaagacaaagtaggaacaatttccttcggcacaggctcaagtgctgaagaagtttttcaagttcatcccctcctggttttccttgtgctctcaagagttcccaatctaagctctaattcagggtcctgatcctgatccttgtgctcagaggaacatggatgtgctttggagcagcccttgaatttgtctgtgttggtgaatttgtgtgacaaatttggggtaagtgtaattgaatattgtcattttatagggagaggatccacagcttccatcctattctctaagggtccagaaaagtgaagctcaaccaccccagacatttcccaggtcctctccctcaccgaaacatactgacctctgtccatttcctgggaacttgtctgcaggcaaatagacaaattaaccccaatgaagatggcaggagatgacagggacctcagggttgctcttcaagagccagaataaacttcatacaacaaaagagtcactgatgtggcatgtcaggacactgatcaaggcattaaaggtgtttgaagattgtaggttaagaatttaaatacagcagaataatttaactcttacaagaccacacagtagacacaaaaatgcttgctaaacagatgtgtccacagtagcccttccctgtgaacaaaagtctttcattgactcactgctcatatctaccccactgggcccaggcaccagccctagcagaaatgcagggactgtcaccctacccacttgctgtgagcagaacctatagcttcagggtagggagaggacaattcaagaggatatggccagcaagggtctcaaataggactttatgcatcatactgcctctttgagtaaggtgaacaactgtctgggttttagcactgaaattcctgcatcctgggaaacctctcagtccccacaaattgggaagatttgttgccctgcatacaaaaatccccaaatttcctccttctgggaagtattcagagcttccatcctaagccaaaacaacaaaagagtggcctgaaagtcctttaaagatgtgtcatttgaaaacataaaggaaagtctttggcgcagaaaatagctattttctggaaaaaaaaaaaaaaaaaagaaaagaaaaaaaaaaagaaaagtgttctctgccagtggcaccacaccaattccttgataactggcagactttgactcaagcagcactcaactttgaatcaaagttaaattaaaaagccctacttcaaactgtcatattttcctccacttgtttcctataactaccccctgctaacccaaacatgtttcccttcacaggactgtccttagtcggcagacattgttgctacagtcactgggaaacactgctccatatataggcaacgtgtcttggagccacatgttctgcccttcaacatcctcctgggatcctcctggggtgctaggaggagtttgattgggctcaccaatcctcagcctttgctagatgaagagcattatgggggatgagaggatgtcacaactgtcccctagaccaatgcttccaacccagatgattatgcctcctccccggggaagacttggcaatatttgaagatgttgattgttgtgactggaaggtttgctactggcatgtagtgcgtagaggccaggggtactgctgacgtaccctacaatgcacaggatagccccccaacaacatagaattcaatgtcaatgtcagtagtcagtgagggtcctctcagaggctgctttatagcatgtggggtacttggaagacaaggcagcccgaagtttgcacatttaccaccttctctgagacacagcctcactgcttctgaatgagaaaaaaagcttgttttagcaggagacagaagaaagcatgaattaacagcaaaaaattctagtctatagaataaaaatatctcctacccagccgaggaatcaggaacaattagtgcctaatataggttgttgatgatgatgccaccggtgattctgcagctcattcctctgttgacttaaatcccaggaatcaggaaaaattagtgcctaataaaggttgttgacgatgatgccactgctgattctgcaactcatccttctgttgacttacgtagcaggctgtttttagcttaattttgaactctttttgaaataccttgcaaattctacaattataaaaaaaaatctacgtagattttaaaaaatgaatttgcaaggtattccaaagagaattcaacattaaactaaaaacagcaccctacataagtcatgttcaactaatacacctgcatatttgcctccaaagatgtgtatacgaatgttcacagcagcattattcacgatagtttaaaagtggaaacaatcgggatacccatcagctggtgaactggccatggaagcatggaacatccacgcaatggaatacatgtgataataaaagggaacgagaacataaatgagcctcaaaaacattaggctaaatgaaagaagccagacagaaaagatcccatggtgtacgatttgattaatatgaacgatcttttcttaaaaataaatctacagaaagagaagattcgtggttgccttgagttgggagagggctcctagggttgggaatggggattgatcacaaatggacatgaggaatgtttctggggtagtgtaaatgtcctaaaattggattatggtgataattgtacaattctgtaaatttacaaaaaaaattgaattgtatacttaaaacaggtgaaattatatggttagtaattacacatcaataaagctcttgccaaaaatctactgaacttggattgtttttctgatatttggtaggaaatgttgtagaaagaacatttaattagaaaaaattatatttatgtcctagccctgattctactcataattaatggcatcactacaaggaaggcattgatttcctcctggactcagtttccccatctgtaaaatgctgagggtcccagaaatactgtttatccttcatgctgtgagctttggttaactggctgctcacatttcaacaggaagagcagatggccacaacttaactcatgagcctgggtcactactttacaacaattaaatcaggcttgaagtccgctttggtttacagagaatgaactgactgtgccaacgtaagtaaaatccagtaccacatggacagctgaagcaatctctcccgcaaactcagcctgcttatcatcagaaaggatgctccttccaaacaatatccctcagaggtatagacagagcatgtctgccatcttcccacacaaacccagggaaggaccaggacactgactacctctcaggcaggcatatacacacccaaagaggttcctctcccctttctaagcctggctatagtgccacttcacctgctttagacaactgctgggacatgcagtgatccacagaccagtatctgcagcaggacagtgcctccccctcaccaatgcctgttaggttgtctctctaaagcgccacttgtcactaggtgggaagaaaaccacagctctaccccttatcatttttaggacattaaaactgcaacaacaaaattaaggggccaccctagttcaaaatattttccaaaatgctgacactttttcattcacaaattcccacctgtgtcatgcatagtgcaaactaattaactaagtatcagtgacaattatagctcctcaatcacaaaattatcttccaaagagaatttccttagcaaggtgaggagatttagccaggctgcatcaaatcagaaacatcatctaagaaagccaaaactgagggatcctgaggcagaggattcaccttgaataccagctgctcatcaagatttattagaggacatgtttcagtgagaacagtagactaagatacacaccagtccagaaatattgaattatttcttctcttaaaacaactcagctgtgtcttttcccaccataccgtttcactgatcctctgaaataatttgcaactctgtcactatatcactaaattagggggcataattctcccaattaagcatttaagtcaaacaagaagaagagaaagaaagaaacatctcctggcatcttttactaaactttaaagtaactgaagacttgttcttgccaaacggtaagtgctaaatcctgagggctgtcacagcttcaaacgagctaacagatgtttgttctcaagcacattttcctctcaatggcattttgagggtatcataaacttcctaacacagtatttcagtggaaacgtttttcgtaagattattttgttatcataaaaaaatcccacaagcatttttgaatatatgttgctctataggaaacaactaatgagatttagcaatgtggaaaaaggtagaaactgccaaggtgagttcatttacaagcacacgtggagatgaaccttaagcaggcctatttctttcctcttttggcctacctcctataactcctagtatagaacagagggacaattggcaatggctgaagaatttttggttgtcataattgggtatgctagtggatagaggccagggatgctgttcaaaatcctacgatgttccaaacagcccctaacgacaaaattacgcagcccaatatgtcaatagtgtagacattgaaaaatgctggcatagacagatataatttcatttgggttcatatctctgggaatgagacatattttctacctgtgtttagcttagtcttagaccagacacataaacacaggtttccaatgtaatacagagttctctcaaatacagcagcctttgtggtgggagggagggtctactgtggaaagaatgggaggtggtgaaatacacttaacacagtgaagagctaaggaagggcttcctagctcttcacataggcctgtgatggaagatgaataagaattggccaaactaaggagagggcaagggcaagtagatgtgtaggcacctccaagtgcctgtgtatagagtgaagggaggaagggccagctctgcagcaccttgaatgccaagctgggttttatctggtgggccatggtcatgagggtcatgggccacttctagtccttctcatgccacctctttcaaattatccattggccctgttgtggactaaatgtttgcattcccctaaaattcatattttgaagccctatctcccagtgtgatggaattagaagatggggtctttgggagataattacatttaaataaggcccttggggtagagcccccataagagtagtacccttataagaaaaagaagaggctgggcatggtggctcaaccctgtaatccccgtactttgggaggccaaggcaggcagatcacctgaggtcaggagtttgagaacagccttgtaaacatggtgaaaccccgtctctactaaaactacaaaaattaggctggcatggtggcaggagcctataatcccagcttctcaggagggtgaggcaggagaattgcttgaacctgggaggcggagttgcagtgagcagagatcacactattgcattccagcctgggcgacaaagtgagagagaaaccagatgttccttcttctctccaccatgtgaggatacaggaaaaaggcagccatctgcaggacaggaagagggccattaccagaacctgaacatgctggcaccttgatgcaagaccaccagaactgagagaaatcaatgcctgttctttaagccactcagtctatgatattttgttatagaagcccaagctgatatttttggaggattaagatggcagataggaggcaggactagcttgcagctcccactcaggtggacacagcagtgtgtggagacttacatcataaactttggctccaagaactactacaggaacataccaggaaagccaagagaatccacagaccctttgaaggaaagggatcaccgttgcaggctccctgagatgccaaaaactgtgagtctgcttgctttttcaagggggaagctggtggtctggggcaagttctcagtcctggtcactggccgcctggaaatagactcaatgctgttgtggggcacagtgggaagtgagaccagcctttaggactgctggctgcatcaggagggggcaaggcctgtgactgctggctttcccacactttcctggcaacgtgcatgacacagcagaggcagccataattcccctgggaacataactccattggactgggaaccactcccccatcccccacagcagccacggcaagccctgcctggggagagtctgagctcagacatacctatccctgccccaacctggtggtctttctctacccacccgggtagctgaagacaaaggtcataatctcttgggagctctatggccctgccaactgcctgagaaacctgaatacttaaccaggcatccctagggcaagcttgcatcttccttatagtaccatagctgatgcactattgaaagcaccacctactggctggcagccaaccaacacaaaaccaacacactaaaccaaaatacaagcaaggaccctcacaaagtctactttactcccctgctaccttcatgggagcaggttctggtatccatggctgagagatctgaagacagatcacatcacaggaccctgcagatgttccccagtaccagcccagagctcagtagctcctctgcgtggctagacccagaaaagcaaaaacaatcactgcagttcagctcccaggaagtcccaaccctaggtgaagagtgcaaagacctcatcaaaggagcaccccgtggaacaaaagaatctgaacaagcagcccttgagtcccagatcttccctctgacataatgtacccaaaggagaaggaaccagaaaagcaattctgctaatatgacaaagcactgttctttatcacccccaaaagatcataggtccaaagatctatggatccaaaccaagatcatagatccaaaccaagacaaaatctctgaattaaaagaattaagggctgggcacggtggcttacacctgtaatcccagcaatttcggaggccaaggcaggcggatcacaagatcaggagattgagaccatcctggtcaacatggtgaaaccccatctctactaaaaatacaaaaaaattagccggacgtggtggcgggcatctgtagtcccagctactcgggtggctgaggcagcagaatggtgtgaacctgggaggcagagcttgcagtgagccgagatcgcgccactgcactccagcctgggcaacacagcgagactccgtctaaaaataaaaataaaaaagaattaagaaggtcaatcattaagcagatgaaggaggcaccagagaaaggtgaagtccaacttaaagaaatcaaaaacctgatacaggatatgaaaggaaaagtcttcagtgaaatagcacaaataaaaaacaatcacaacttctggaaatcaaggacacacttagagaaatgcaaaatgtactggaaagtctaagcaatagaattgaacaagcaaaagaaagaatgtcagagcttgaagaccagcctttgaaattaattcaattcatttaacacaaaaaagaattttaaaaaatggaaaaagcttccaagaagtttgggactatgttaaatgttcaaacctaagaataattggtgttactgaggaagaagataaatctaaaagtttggaaaatatatttaagggaataaatgaggaaaactttcctggcctgctagagatctagacttccaaatataagaagctcaaagaacacctgggaaattcatcacaagaagttcatcacctaggcacatagtcatcaggttacctaaagtcaagtcaaagaaaagaattttaagagctgtgaggcaaaagcatcaggtaatctataaaggaaaacctatcagattaacagcagacttctcagcagaaaccctacaagttagaagggactggggtcctatctttagcctcctcaaacaaagcaaatatcagccaagaattttgtacccagtgaaactaagcttcatgaatgaaggaaagatacagtcttttccagacaaacaaatgctgagaaaatttgccactatgaagccaccactacaagaattgctacaaggagctctaaatcttgaaacaaatccttgaaacacacaaaatagaacctccttaaagcataaatctcacaggactatataacaataacacaatgaaaaaaaggtatttaggcaacaaatagcatgatgagtagaatagtacctcatatctcaatactaacattgaatgtaaatggtctaaatgctccacttaaaagaccacacaatggcagactggataagaattcaccaaccaagtttctgctgtcttcaagagactcacctaacacataaggattcacataaacttaaggtaaaggggaggaaagagatattccatgccaatggacaccaaaagagagtaggggtaactattcttatatcagataaaacaaactttaaagcaacagcagtttaaaaagacaaagagggacattatataatgataaaaggactaatgcaacaggaaaatatcacaatcctaaatatatatgcacctaacactggagctcccaaatttataaaacaattaccctgctagacctaagaaatgacattgatggcaacataataacagtgggggactttaatactccactgacagcaccagatgggtcatcaagacagaaagtcaacaaagaaacaatggacttaaatcataccccacaacaaatggacttaacagatatttacagaacattctatccaacaactgcagaatatacaatctattcttcagcacatggaacattctccaagatagaccatatgataggccacaaaacaagtctcaataaatttaagaatatcaaaattatatcaagtactctctcagaccacagtggaataaaattggaaacaaactccgaaagaaaccctcgaaaccatgcaaatacatggaaattaaacaacctgttcctgaataatcattgttttgacaataaaatcaagatggaaataaaaaattctttgaactgaacaataacagtgataaaacttgtccaaacctctgggatacaccaaaggcagtgctaagaggaaagttcatagcattaaatgcctaaataaaaagtctgaaaaagcacaaatagacaatctaagctcatgcctcatggaactacggaaacaagaacaaacaaaacccaagcccaggagaagaaaagaaataatcaagatcgagcagaactaaatgaaattgaaacaaaagaaaacaatgcaaaatataaatgaaacaaaaagctagttcattgaaaagataaatataattgataggccattaacatgataaacaaaaaaaagaagacagaagatgcaaataagctcaattacaaaacaaatgggagatattagaaccgataccacagaaatccaaaagattatacaaggctactatgaacaactatatgcacataaactagaaaacctagaggagacagataaattcctggaaatatacaatcctcctaaattaaatgaggaagatatagagactctgaacagactaataacaagcaggaagattgaaatggtaatttaaaaaattatcaaaaataaaacatccaggaccaggcagattcacagccgaattctatcagacattcaaagaagaattggtaacaatcctattgacactattccaaacaatagagaaagaggaaattctccctaaatcattcaatgaagccagtatcaccctaataccaaaaccagggaaagacataaccaaaaaaatggaaactacagacccatatccctgaagaacatagatgcaaaaattctcaacaaaatactagctaacagaatctaacagcatatcaaaaagataatccaccatgatcaagtgggtctcacaccagaaaggtggggatggtataacatatgtaagtcaataaatgtgatacaccacataaacaaaattaaaaacaaaaatcacatgatcatctcaatagatgcagaaaaacatgtgacaaaatccagcatccctttataattaaaaccttcatcaaaattagcatagaagggacataccttaaggtaataaaagccatctatgacaaacccacagccaacattacactgaacagggaaatgttgaaagaattcccactgagaactagaacaagacaaggatacccaggttcaccacttctattcaacacagtactggaagtcctagccagagcaattagataagagaaagaaattaaggacatccaggtcagtaaagaggaagtcaaactgtgactgtttgctgacgacatgattctatatctagaaaactctaaagactcatccaaaaagcttctagaactggaaaatgatttcagcaaagttgcaagatacaaaattaacgcacataaatcagtagctctgctatataccaacaatgaccaagctgagaatcatatcaagaactcaatcccttttacaatagctgcaaaaaaaataaaataaaatacttaggaaaatacctaatcaagaaggtaaaagacctctacaaggaaaactacaaaacactgctgaaagaaatcgtagataacacaaatgggaacacatcctatgctcattgatgtgtagaatcaatattgtgaaaatgaccatacagccaaaagcaatctataaattcaatgcaatttccatcaaaatatcaccatcattcttcacagaactagaaaaaacaatcctaaaattcctgtggaaccaaaaaagagttcacatagccaaagcaggatgaagcaaaaagaacaaatctggaggcatcacattgcctgacttcaaactactataaggccattgtcatcaaaactgcatggtactggtacaaaaatcatagaccaaaggaacagaataaagaatccagaaaagaaataaagagtcaaatacttacagccaattgattttcggccaagcaaacaaaaacataaagtagggaaaggccaccctattcaacaaatggtgctgggacaattggcaagccacgtgtagaagaatgaaactggattctcatttctcatcttatacaaaaatcaactcaagataaatcaaagacttagatctatgacctgaaaccataactttcatttgagaagataacatcagaaaaactcttctagacattggcttaggcaaagagttcatgatcaagaacccaaaaacaaatgcaacaaaaacagataaatagatgggaattaattaaactaaaaagcttatgcacagcagaagaaataatcaacaaagttaacagacaacccacagagtggagaaagtcttcataatctatacatctgacaaaggactaacatccagaatctacagagaactcaaaaaatatcagcaagaaaaaaacaaacaatcccatccaaaagtgggctaaggacataaatagaaaattctcaaaagaagatatacaaatggtcaacaagcatatgaaaaaaataccgaacgtcactaattatcagggaaatgcaaataaaaaccacaatgcaataccacctcactgctgcaagaatggccatattcaaaaaatgaaaagataatagatgatggcatggatgtattgaaaagggaacacatttacactgtgggtgggaatgtaaacaagtacaaccactatggaaaagtgtggacattcttcaaagaacgaaaagtatatctattatttgatccagcattcccactactaggtatctacccagaggaaaagaagtcattgtacgaaaaagatacttgcacatgcctgtttatagcagcacaatttgcaatttcaaaaatatggaaccagcccaaatgcccatcaatcaactagtagatatagaaaatttggtatatctacataccatggaatactattaagccatgaaaaaggaattaagtaatggcattcacagcaatctgaatagaattggagatggaattggagactatcattataagtgaagtaattcaggaatgaaaaagtaaacatcatatgttctcactcataagtgggagctaagctatgaggaagcaaaggcataagaatgatacattggacttttgggactcaagggtaatgatgagaggtaagagataaaagaatagacattgcatgcagtgtacactgcttgagtgtaaccaaacacaacctgatccctaaaaacctattgaaataaaaataaaacaaatcaaaacaaacaattaaaataaaataaaattttaaaatgaagttttattagaacataaaaaaaaaagtagcccaagttaactgagacagaaatttgtaccaagaagtggggtgttgctctaaaaatctccttaaaatgtgaaagcagctttagaactggtattaggtagagactgacagagttttgaagtgcatgctagaaaaagccaagattgccatgaaaggactactaaaggggagtctgatgaagactcagaaagaaaagaagaaatctgcagagaacacatccaccttcttagagactacataagtgattgtgaacactgaatgttggtagaaatatgagccattctgatgaagtcacagatgaaaacaaggaacatgttatcaggcaatgaagtaaaggtaatccctattatatagtggcaaagaacttgactaacgtgttcataaatgaagttagctatttagctgaggagatttctgagcaaagtgttgaaagagtggcttggttcctcccaactgcctatagaaaaatgtaagaagagagaaatcaattaaagaaggaattgttgagtaaaaaagaaccagaacttacagatttggaaaatccttagcctatccatatttttaaaaaatgagaatgtttggaagataatattaagggtatggctatttgatgaggagactactgtgagtgtcaaccatggacctaatcagccacctcaacagaagcaagaaatgggattagcaaaaactttgacaagtagtatgaaaagaaacagagaaaatgagacagaatgaaggctgcaaacatataccattcctcagaggaaaaaataggatgatagggaagatgattcagagattattagggctaccactttcaccacaggcttatgaggtggacctagttcctccttggtctcaaaggatggggctaactctctcatttcaataggtcagaatgttcccaactattgccataggggtggggccactgaagatatccttgtgggtgggtccccatggagcaggaggagcagggccagtccattgcactgtgagaatgatgctgccatcattgtcctgctaagacaaatttaaatttttgtcttgctaagaacttccttatgacccatcactccttccttctttcctattcttcccttttggaatgagaacgtctatcctatacctgtctcatcattgcagtttggaagcacacaacttgtctggtttcacagattcatagctggagaggaattctgtctcatgacgaagcatacctcaagtctctctttagactagacttcagactttaaattttagagctgatgctagaataagttaaaatttggggggctgttgggatagaatacatgtcttttgcatgtaagaaagacaggaatttcagagggccatgaagggaatgttacggactgaatatttgtgttccctcaaaattcatatgtcaaaggctgaacttccaatgtgatggtattagtaggtggagtctttgggaggtgattaggtttagatgaggtcatgaaggtagaccctccattatgggattagtgtccttataagaagaggaggagataccaggcctacgagacacagcaagaagttattcatctgcaagccaggaagagggccctcaccagaacccaatcatggttacatcctgatcttggacctccagaactgtgacaaataaatggctgttatttaagccacccagtctgatattttcttgtagcagaatgaacagatgaagacaggtcctctccacttttcacttttcttcatgtccagcttaaaatccttgatccagtaataaaaaccacatcaccaccttgattacattctctgttctttccacctctatcctttatcaatgccaatgaagaccttcattcttaaatgggatctctttgtattccttcttagagccacacatgaatctacaattgtctcaaaataaaatattttttaaaacgcaccttctttctggatgatgccaactatctgacatgcctaaaagtgaacaactcaagttagtgaagatactttcaggctgattgtggtcatcaactttacatggaacctctctcccccatgctttccttctcttacactcattcttttatttttattattgattctcatgtgtgtgaaacacaggtagaacagaggcttgaatgtgccttggtctctgggaggcaggacaagtctacttttagcatgtgtgctaggggaagctatatctcacttactcttcaacagaccccaatctgtcttttgtttccaccatccagtgaaaggcaaggtcaccgatgtctttatctaccaaatccaaagggtgccagtgagatattacttgacctcgcattagcatttgacatattctcgtctctgaaaatattcttctctcttgacttctatgtgtctcctgtggcaagatatgaaagtttcagcccatgtgaatatagaaacttcaccacgcttgggattttctccatttgttttgtgctgtatgagacagattaaagataaattcttctcctcacttccgggggaggttggaagtctttggtcttcatggaaaggcaagccacacctggacttattctggctctgagtttaatgggccatgaggagtaagaagacagtaggtttcaggggggcatggggttataaagaaggtttgagataaggatgcacaagagaactgctagagggatatggaagcaatggagagattaccaccagatggagcccctggaagtgaggtgctaatatctggaaaactgctgagaaggaggaggatccataatccagggagcattagaaaagtggacccttctgaatatcatggcaaagggcattgcttgagggcccaggaggctgatgagaatggaaccttgcctgacaatcacccagtcttcttccaatggaaaatgttgcactattttcacatgaatgtcttctctttgtctacacccacaccagagaaagctcctatctgtctataccagcactttacccactggctgaagacccccagctatgccccaagactatgcctggttcctatcgcatgacctcacgtggatgttccttgttatggtttaaatgtgtgtgttcccctaaaactcatatgttgaaacctaattaccaaggtggtgttatcagaaggtggtccttttgggagatgattaggtcatgagagtaacgtcctcataaacatgatttgtatctttctaaaagaggccccagagagctgcccagacacttcaccatgcgaggatgcagcaagaagaagccatctgtgaaccaggaactggtcctcaccagacactgaatctgctgacaccttggttttggggtttccagcctccagaacaatgagatgtaaatctctgttgcttataaaccacacagtctacgacattttgttatagcagtccaaacagactaaaatttttcttacatattttaaaatccccatacccataagcctaaagagtgaggtctgttcatgaagtgggcatcccctgccccctaaacttagtggtgaagagggacaaaatatgtaagctcaaaggctacaagctaggacagttgttcctgagcctcgtcttacactgccttctccacctcttcctctgactttgccggacgcatttgctccatctcctctgctggttcctccctggttctgaatacctcggaactctgtccttttttcttcttcttcttctgcctagaaaatcatatctattaccatgactttaacaacacccacattctgatcactccaaattgatacattcaggccaatgaaacccaggtttagacatccagctgcttacttcatgtccacatctgtgtgtttcatagacatctgaagcatagcatgttgaaaattacagggcccttatgatgtgtttctgccaatctctccaaccaaatgacaagccatcccttccctcaacctttcaacacaacagcctcttgggcaccctttcctttctcaaacatgacacaccctttctcatcacaggggctgtgcacatgatattccttctgccccaaacttcctccccccgcattgcttgctcttgtcattatttcaactgtcatctcctcagagagactttctctcccactctgtatctaaagtaggtctcactgttattttctatgaattcaccctctatagcataaatcaccattatgtttatctgtattgtccttcacccccctgccccacccaataacccatgaatttcatgagggcaaagactatactacatccccagtacctggaatactgtctggttcggagaaaaagagaagatgttcgataaatattcattaaatgaatgactggtaaacattagagtatacatataataatattatatatatgtatgtatgtatgtatatatatgaagttgaagaggtgtagagaggtgggtaagagatgagttttattttacatgtgttgagcttggaggacatagaggaccaatgaatggatcaatccagcagatgattgggctctaagtgtgaaggtaaggggggccagagataaagatataggaggaattcaacaaaactatggccaaagtcacagatgagaatgaaatggcccaaaaaaagtcagtagagtgagaataggggaccaagaacagaaccccacagaaaactacctagaggttacctgctgctcagtcaccactatttcaccatttccaccaagctctcctgcctactcctctgccttgtctagaatagggggccaggaacttagtaacagtcaccacggtaggcgctgggaataaacagtgaccaaaacaaacttggtcactgccgtagaacagttcatgggtagtgaaagcaagccatgtggacagtcactgggtggcagagaccatgcctcccagtttttttctcttcagttttagttggtcatctgactgcccagaggaaaagctacatttcttaattgcctttcttgcaatttggtgtagacatggattaagttttagcaatgggttatgagcagaaggaagggacactgttgtgagttgaactgtgttccccacaaattcatataataaaatcctaacccctgttgaggaatgtgaacttatttggagataaggtctttatagaggtaatcaagttaaaatgaggtcattttaaacaaggaccttatctaatatgactagtttctttataaaaagggggaaattggacacagagatacccatagagagaagacaatggaagagacaaagggagaagatggtaacctacaagtcaagaagagaggcttggaacagatcttttcctcacagccctcagaaagaaccaactgccaatactcagtcttgaacttctagcttccacaactgtgagacaatacatttctgttgtttaatccatcagtctctggaactttgttacagtagcccttgcaaactagtaaagaaaccacttcgaggtcataactctagaaaaggatatgtatgaacctcctggcccttctcccactttgctggcctggggatgactagacttgcagcagctatcttggatgcagaagtggaagccatgtgttgagtttggcagggccacaccacagttgacaaagcacccttgactgcacccctctggactgttacagaacagagaaagaaaggtttgtttgttctaagccacaatattttgggtctctttgttacagtatagattccttagcctgtattctaactgatacatattgcataaaggtcatggataactgtaaataaagtcatatatgacttccaaataatgcttgaaaatgaattatatttgacctcccatcctaattatacattctacatcaaatttatagaattgaaagtacatcctgccacatctgtctctgcctcctaaccctccagattggctggtctcatcaattctaacttggttttcattattgacttcatctcttttcccatttgcagaccattcaaagaatctcttccaagatttttccttcatattccttaggttaccttagctcctctatttcactccagtctggttttcaagtttaaaatgctttccagaatacaaatctgacactccactattcttttctttccaacccaggcacaattcaacatgattcagccatcatcattacaggtaaagtactttcctaaaacactcatcttcctctgctctgtcttttgctgaggtatgcagccccctttgatgttaaatggacttctttctgtgacagtacttgaagacaatgggatctggctagacatctgtaggtttccttaatgtcagcattaaatacagatttattgttaattgatacatttatgccgagttttctaaatcaatggaaagtgaaaaaaaaaaatgctcacaaaatgctaagaattttttctcactttaaggaaagtccatggcaagaatgttctcttatctaagcaggaatatctagagtaaaaaatttggaaatcaaacatggttactgtagtgtttttattctaatcgattccactgttctcgagcccattttttttcatccagatattccatgaaagttcaaatagggaatacattctacattccagatcaaaatttaaaatcactgaagcatttgtctacaaatgcaagctgattggtcaatcctacgttctttctttattctagaatgaagggcaatgtggatacatctgaatcattcaacaatgacataacttaccttctctatgacccaatttacttgcctaattttggtgactcagtggactaaggagaagatgaaatatggagaaattatatttcttttgctggatctgtcagaaaaaaaaagtgtatgactttggggagaaaaatatccttcctctgactttgcttccacatttgcaaaacaggaacagaaaagtcccactaacttagtaataaattatctcattactgagtgtaaacactgttattgtttagcatttatttctgcaatctgtcaggatattttgaaatttctccatgaactatacatcttaatacagtgtttctccttctctcttcacatggcgtgtcggagaaagcgaggcagaatggtgaacacatgggtgatgtaaatgaaatgctgtttaatttattttcaaatggataaaaggaaatgtaattaagctccctaaaagccttccaaataaacttcccttaaaggagtagaaaaggaggttgtaattgatcaaagtagctacgtcaagtgtcagattccttgacacttggagacagaccagattaagatagccagcagagaatcaattgcagtacaagccagaggcttcacaggactgggggaaaataccagaaatgtggattagatgctggtcagcatcaagaagcaaacacactccatgtctgaagtcttgggcttagatgtacaactggtgtaagtgaaccctctctcttcttaatgcacaaacaagtcaatgtgtgtttatattagataagcagatgatagatgatagatagatggatagacaacagatagatagataatctcctatctttttatttaatgaggaaaagccaagatatcagcctaaaaccactaaaaaagagagagaaagcaagccctatgggtctgcaggtcccaagagaaagacttccttctgctacattgcatgctaccaaggatagcaggggatccacagcaaataatatctactcaagtctgtattgtacatttgttaaattctgatccctgaccaaaaaaaaaaagaaggaaccctggtagaacaactataaatatacatactcaacatctcacatgtcccatagtaaatgccacaaaatgagcatgctttgtatttgttctaaaattgttactcttcagagtattcaaactaaaaacaaaactatatttatatctcaggattctataactccaccagctttggaatggcaagaatgagaagtggtcaccctcttagggtcattaatgttcctgaaacttacacttcatagaaacaggcatttttatcctttttaaaaatatatgtgtatgccctaactaatcaacagcctggacacatagacccaactttgaattgattgtggaattaactctcgtgtcaatagagaggaagtcatcaaggtgtaaatttcctctctcaaggattatatgtctttatcataaaaatcataaaataaaatcatgagtttccattaaaaagtgactattttatgatccacagtttatcaactgtcagctatacactgttttgattctttgctttcctcttttcaacatgatcaaatatgaacatgctattaagtcttaaccctggcatgctatttttgaaaagatattatataatgaatatctgccataaaatagtatataagtatatgtgataatcaatcgcaattgattattttagtttattgtctttccaacaagacagtgaagattcgaagcattctattgttaaaataaggttttaaaaacagaaaaaaaatgaaaaattaccaggaatggagaattaaagcacaatataaaacccctgtaataaagagtcattgcctcacagatgaacataaattgaaaaatctattgctttttttttctgcagacatttctcaggatagtgccatactaccattcatgggagatgcttatcacaaatagtcagaaataatgtatctcagggagaagtatttcattattaggtatgatgaaaagcaatattactagaggcattccatcatcaagttctcttagcctattttgaaaggtctttaagaaaaggtattcacaagcaagcatgaaaactatgaagcatcaaggcagttgatgattctaataatagtataactgatcatttatacactgtaaatataacctactgagctcatcataatgattaaagttgaagtttaagacaatgcaaaataaatgtttaaatgaaacacactgagatgacaacagtggttaacttagagtgggtctgatcagcggtcttttaaatttcattctttctagcttgcaaattttctacaatatataggtagtatttttataataaaaattttaattttgttaattttttccaggcttactaatattttcacctgcaatgtgcttccagtgtgtatgagtcaaaatctttgataggactttgaagtctacaaaagtgagcggaatatcaggaaaactgattttaagcccacatgtcacaagccaaaggaacatgtccgatttaagctctctgtgcacgaggtttaatatctgtaaaaacatcttctcctggaaaaagatacccctaactgaaaacagccgttgtgtcatagagatgggaatgagattagattttattttctattttgcacatgcctacgctttaaatttatttcatttggaaaaaaatattttctgttttcttggaaaaagtttgactttttaatgacaattttacaggcatcaacaattatgcactttttgattgcacagtaagaactgatctagaaaaaattaaattgagatacttttcaaactggaagaaatttaaatcactgaggtaacaagtatggggtttcttttgggggtgagggcaatgttctagttagatagtggtgatggttgcatgatcttgtaaataccctaaagatcattaaactttaaaatggagaattttcttgtatgtgaataatgtctcaaagcaaaacaaaactagaagatactgaggagcatcagatttgggacagaattacctgagctcgtatgaatttgttttcacactactgtaaagacactacctgaaactggaaaatgtataaacgaaagaggtttcattgactcatagttccatattgctggggaggcttcaggaaacttacaatcacggtagaaggtgaaggggaagcgagccttgtcttacatggaggcaggagagcgagagggagagggagagggggagggggaggggaagtgccacactttgaaatcatcagctcccatgagaactcactcaccatcacaaaaatagcatgggagaaactgcttccatgatccaatcacctcccaccatgtccctccctctacacatggggattataattcaagataagatttggatgaggacacagaaccaaaccatatcagagaccattccgtataatcactgtctcctccttgccaaaaagtgagagacagacacaggactcagggacaatcagcagaggctgtcacgtccttaaggccatctcatccataactcagatttttttaaatcaaattgtgttatacaagtgggctcatttggccatattaaggggaggctgtcagtgaagacattttcttacctcattaggacaagaaacattcttgctctctcagagtcagagatttgggcgacattatctctctagagtatatgccttgagtgtggtcaccccaagattttctctaccctctgtagcctatgttgatacctctgtcagttggcttttgctgcataattaaacatccccaaatttagtggcttaaggcaaccaccatccatgtggctcatgtatacaggtcagccatgtgggctgaagctcttctgggctcagctgctcaggtgagtgagctggctgtgggccagggtgatgggtgactgggcaatgtctccctcttcatacagcaggcaaacctgggctctctcatccagcacagcatgcttcaaaaagaacaagtaaagcgttcaagatcttttaagcctagacctggaactgcacaggccacttcatccacatcctcagggtgagactcagtcgcaagtccatcctggacccaaggggtggggaaataggcctcacctcttgatgggaggaagcatagagtcacattgcaagatgtgggacacaaggaggggaaacatgcttggaagcaacctaccgccacacagccccaacaacatagacttcaaaattgtaaacacaaaagaaagaaacattcaagggctctcagctcacacagttaatcttcccagtgggacacagggaacataatgatttaatgacttcgaagccatgtattattcaaagaggaagagttctcactgagaaaacatcccaagtaaactgaaacacatctgcactcctcattactgttcctctccctccctgccctccttagagccctcagttactgctttaggtagataaacagggtttgattcaactgaaaggggagctgtagccattatacaacctcagatgaggattgctgagagagatctagggatggtaaatggcgactcaaagactcctcaatgagtctaagcctagggaaggtgctgagtttgtggttcttaaagcaaaggactcgaggtcaccatcgctcagagatgagacaatctctcagctccatttcatgctgatatatttcctcagatccattacatgcgagcttaatttttttaaggtgaaggtttctgcaacctggaaaacaaagcaataatcttacaatacagtagaattgggcagaagtccccaactatctctgcacatcagaatcgctgagcacacttaataaaaacactacgtcttgggctccatcctcaggcattgtgatccaataggtttagagtttagtgcagagacataatttcagcaagcttcccagttgtctggatgagcttagttttattaggtaagaaatggggataactgtatctgctgcatctggcttccactgatgtatcaatagatacggatgggtgcggcatgctgacatgaggtgcattaaagcagataagccatatcaaaacacaaaacctccacagcaggcaagcttatactgggcatattccaaccttactttgcaagatgtccattttcagttccttgccatctactgattactcattaaaatctaggacattcatgttaacccaggcatactgtaggattgtgtacagctgcaagttacaaatatgcaaaaaaagcgtactgcacaagacagaaatgtatttgttcccatgtaagtatttcagccctgtcatgacaagccagctccatgaaacataaagagacccccagctcctcccatctaaccactttgccatgcctcaacctcatgatataaaataaaattggggatccagaaatcacatttatatcccaagcagaagtctggagaaaggggaaaagatgaagcaaacagccccttcttttaaagagcattcccagtttgcacactctattttcacctgcattccattgatcagaaacttaagcacatggaaaggaagtcactagaaagaaagactggaagattccatctctattccagactgccatagggggctgaaatttctgtggaagaaagataaattgtaggacaagaagaaacccctgccatacccaggctttgtcagaacgcctatctctgctttgagcctataaaattttcataccccaaagtgttcattgtggaattatttattataacagtaaaaatttgaaaacaaataaaatggccaacaataggaaaattattaagtcaactacagtacatcaatttcataaaataacatagaatcaccagaaaagttggttaccaagattatataatcctttttagcatgtagtggtgtctagcctcttccactttctctcttaaatacctgcaaagcacaaacactcacagcactgaaaacccggcctgagagacaagccagttcctccatcctagaggaaataaccacaggcagcacaaagagcttgatttagataaatccaaccaggcttcagttcacagcaaactcaaactctgctttatgaaacaaattcctcctgaaaacaaaaacgaaagaacaaaaacaagaagacattttccatcccccaaacatctgtcccaaggccctgaactaattagtattctggcccaggatcccaggccacccttccaggactgggagatgaacagagtcgattttcccaccagcattcctgagctctcctgccatcatcagcctatatccacatggaaacatgaatcccgggaaagagcttggcaggaagtcaggaagaggagatgccagcagaatgttggtgctttctggccaaggatatctcaggagtaaaactttataggtggagagggagaaagagagagacccttgatagcagtgcaggccaacaactgtagctgtgcaagaactttattggttctaaatataaaaaaacaacacagggagggcagatgtacattaggtgagaaccttagagactgagaatcccagcaggagctctgcacatgaaacagcacctccctttcatctgtaggttcaagaatggattctttcactttctaagtgagcagagagaagactcaagcacaccaccaccaccaccacccccttcttcttcacaagcacgggacaggaacaggtatttccatgcttggtgaggagtgtcaataaaagcacaacctcaaatctggaaaggtcattggagggacagctctttgatgaatcttgtgtattagagagttgaactttacagtcattatttggcatcttaagtagaatgtgagaaggtctcactattttgaaacacctgcagaatgtacacaaggctaggaccaactgaaatgaagaaacaagagcatgatctaaacaggaggtgcctgggtatgattccaaagagatgcaagatgctatggcaaatagaacatttctgaaaggatacatgagaaattgataatagtgattgcctttgagacagggaagtggggaaccacagacacaagcattaactggaaaatcatttggtggtatgttattttgtacttaattaattgtatcaggtttattaaattttcaataaaaagagagatacttgagacaaaaacaacactttcactttggctctttctccgttaatttctagccttatgacctggggaaagatattaaaatcactccacgtgtcagtttcacatgtataaaatctaagacctgaaagtctagcagccatgcccagccctggcaaatgtcacctaaggctggggcttggaagtcaccatcaagaaggggaaggagcattccagttgactctgtggtcatgaccactgctcttgctgtcagtaacacctgtaatcacactacatttttgtgagattggcttcgttcttttcctttaatacactaaattctttccttccttaagactttcgtataggttaatccactagtttttaatgttttgtttctaattttcacatggctatatcttactcaattttctgatactgattatcagatgtcactgttctgattccttgatgtcacttcctcaaaaaggacttccctgaccccccatttatactttctcagaaaattttgttcttttctttcataatatgtaatgtatgcatgtgtaattttttttttttttttttttttgagacggaggctcactctgttgcccaggctggagtgcagtggcacagtcttggctcactgctgcctccacctcccggattcaagcaattctcctgcctcagcctcccaagtagctgggactacaggtgtgtgccaccacgcctggctaattttctgtatttttagtagacacggggtttcactgtgttagccaggatgctctcgatcttctgacctcgtgatccgcccgcctcggcctcccaaagtgctgggattacaggtgtgagccaccgtgcccagcctgtaatatttatttctgtaaaatatatgtaacatatgttatatgtacatatgtccttttccttgcttttcacatacaaatttatatggcagtttattgcatattaatgtattcagagttagacagtattctaatggataatctgtgatttttaatcagtcccctattgatgaaattaagataattttcccattcttttgctggtaaaaattgtgctacaataaaaaacagtaatagcttttttaaaagatactatgacagagataacgttgcaagggtagacactgttgctgctgcaggaagtagacagcaatgatgagtaggtcaaagctgactgctctctcagaatgaaagcatctcttcctctccaccaaaaaaaaaaaaaaaaaaaaatcttggcttggaaaaacagaacaagaactgtccaggacttatgtttttcaagaataactataaaatgtcatgaagaataaaaaagacttatataaaagtatatttttctggattagaaggatttaataataaaaagcaaaccagtcttccccttttgataagagtgtaaaatgctatattttgggagaggaggcaatttggcagcttatcatagcgtttctcaaccatttttctttcccattatcattcccctaaaaaggctttttagatatttttcctcatgctctcacccatgaaattttaatcctacagatatgctgaatatctactcatatgctttatatataactatgctcttgacatagaaacagcaaaattttgtcatccacctccagacaggaagagagggagggaggaagggaggaagggagggaaaagggaagggaagggaaggggaagaggaaggggaagggagggaagggaagggaagggaaaaggaaaggaaaggaagcagaaaggcagaaaggggggaaagaggaagggaaaaaggaggggaggggaaaggacaggaggggaggagagggaaagggaggaaggaagggagggaaagggaggaagggagggaaaggaaggaagggaaggaaaggaagggaggaaggaagggagggagggagggacagatggacggagggaggaaggaaggaaggaaagaaagaaaggaagatatgctcctttgggtacagtttcaacccaactgaaaatgcatgctcactactaattcgaatagaagttgtctccatctgggtccagtaggaagcagaattcaaatcaaatggttcaaagtgccacttacagaatgtgggcaacactgatagaactaaaaaagatatgaggcacccagagacaagccacatggagtggtgctgtcactcaagaagtttgccttggagggctgggggaggaaagtgttgcccgcctgcctcctgagaactgaagctatggcaaaggaactgcccacccagcacaattagcagatgtgtagggcacaggcactgccaaaacatggcaccagctttggagtggaagtgcctccttcccgctctcccaccagctttccgtcttctgcgcctgactccccttagtcaagctcacctggaggccacacctataaaactgacagtaattcctgaaatcatctaatacccagtccataatcctatctctccagtagtccccaaaatgaatcaaggaccactcatgcttctagtatttagggttgttaggtcttttctgatctggaactttcttcataaaaccgacttgatggaacagcagccagatggtgttctgtgcaatgtctcaccttctgaatgtggccaactgcttcctcatggtgccatttagcttgatattctatcctttgcatttcctataaactggaaatgaggcctaatgcctggactaatgttaagcttttctaacaggattacatcacagggatgggtaaggctgtggtccgcctatggctcactgcagtggctcatgcctataatcccagcactttggggggccgaggcaggtggatcacctgaggtcaggagtttgagaccagcctggccaacatagtgaaaccccgtctctactaaaaatataaaaattagccaggtgtggtggtgggcgcctgtaatcccagctactcaggagtttgaggcaggagaatagcttgaacctgggcagcggaggttgcagcgagccaagatcatgccactacactccaacctgggcaacaagagtgaaaactctgaaaaaaaaaaaaaaggcaggggggaagagaaaggaaaagggaaaggaaaggagacacaaggtatctatcccacctggagttatgcaaacatggacatctcctaagtagaggtgatgaaaaccagacccttgcactgtaagatacagcccccaacccaacagaaaactgacttgtgcagtgttcagcttgccaccaaagatgcaggctttcactaatctccagcctaatggttttttaaccaattgatgaagctgttttaaataaattatttcctgatataaaatagcaatgtctaatactatcatttcctttctacttactagctggtattctgtattatctgttctcaggctgctaatagagacatacctgagactgcataatttataaaggaaagaggtttaacagactcacagttccacatggctggggaggcctcacaatcacagcagaagagcatgggatgtcttacatggtggcagggaagagagagcttgtgcaggggaactccccttcataaaaccatcagatcttgtgaaacctactcactatcatgagaacagcacaggaaagacctgcccccgtgattcaattatctcccaccaggtcccttccatgacacatgggaattgtgggggctacaattcaagatgagatttgggtgtggacacagtcaaaccacatcacattcttctgtaagatggaactttctctcaacaactagactatttggttaccctaaaaaacagctcctcctggggaggcatgataactgctcaattttcctgcttctcaaattagagtacatggaattgctgcctcaaataaagtcaatgagatttttcaggctttttcttttgtgaatattgttaaagacacatgtatttccacacattcaatctgtaaaaataacaaaaatagctgtcacgctcaaattgttataagtttagccaatgggagcactttcaagcttaatcctattttttttgtatattcatctgagaaaccttccttgctttctggcacaacaagcgattccagactcattttatacctttcttggcctgaaataagtcactgctccaaggagccatgattccttacaggggtaaatgttattaaaggccaaaatccagtgggttagggtgcccattgctaccaagctgatattgtttctaggccatttcagtggtcagaaaaagaaacggtaatttttataattacatttaacatttacatttaattacatttaacatttacattacatttaacattataagtcatagatttataaaatatttttaatctatcattataatgtccttcactttatcctataaaatacataaaataatttttgtataatgatgctaatatcattactaataaatccataattcacttgaagcttaaaatttctataactcttcttgagctgtaacaaattaaaggtttctattcagttccatatattaatgtcacttaaaataaatcttttccatggtatgatatgaatttgacatacaattatgtttcaatttgctttaaattttactaatacctacatgatcccagggttaaaacaacgtaaaaagaaacacactaaaatgtctcaactggaaactatttcattggtttcttatttattcttgcactttttatttttacaaataggtacataagaagaaagaatacttttgcaaaaagtcagcccactgaaatacattaattagtaaattttccacttaatacaggttagggctaacctatatcgttttaaaggctgttcaagataacttttttataactacacataaaaaaagaggtttgcttttttcagtgaccatgtactacttctgaccttaaaacatatttttgaaaaaggaaaacaaatttagggacacattttagccccagtcttgtttgtcccgtgggcagcatttggcatttactggtcacccctccttctggaaaccttgttttttccatttccatggatccacaccccttgattttcctgccttctacttaccaaattccactggcaatgctgctccttctcaccagctcttaccacttggcattctttagggtctccaatacttctaatactacacaccctcccaggacaatttaatctacccttttagctccaatttccacctctgataatgaatttcaattctataactttacccagctcctgagcctcagaaatctatatgcaactgctgacaggatgtctcccttttccgctcacagacacaacattttcaacaggcaccagcttgagttcatcaccttgtgccccttcctccttcctcctccagtcttcctggagttagaaatggtaccaacctaggggcacagtcatcaggcttcccttcacctgtcacctcctttcttacccacctccagggcaatcccaatcctctcaattctacctgcaacacgacatcgctgtacatccatttgtcctagtccagtccatctcctggattgggcaagcattgtctctagtctattccaacacctcctgcttcccattttcatcctctgtgacccacttgccatgttgtattcagaacaatcttttaaaacataaattgggccaggaacagtggctcatgcttgaatgtcagcacttttggaggccaaggcaggaggagtacttgagtccaggatttcaagaccaacctgggcaacatagtgagattccatccctatacacacacacccgggtgtggtggcatgcacacacacacacacacacacacacacaatcacacatatccaggtgttgtggcatgcacttgtagtcccagctactcaagaggctgaagtgggactatcacttgaacctggaaggttgaggctacagtgagccatgatcatcccactgcattccagcctgggtgacagagacagaaggagaccttctctctaaataaataaaatacaaattaagtatcaggtaaatacctttatctgattaaaatccagcaattccttattatcacaataaaatccaagtttatgtacttatatttcaaacaaatttacctacttctaatccttgcatgatggagtttttcagcaataccttctacgatattccgctttgctaaatgttcattttatttctagaattcaaaatattttctagtaccttcatatttctgcaaagctgtttttcctctacctagaatattacttttctcctcaactcctctttcaaatgcttagctcatactcattctttaggtcttttttatttttatttatttatttattttttgagacagagtttcactcttgtcacctaggctggagtgccatggcacagtctcagctcactgcaacctctgcctcctgggttcaagcaattctcctgcctcggcctcctgagtagctgagattacaggcatccaccaccatgtctggctaatttttgtatttttagtagagacagggtttcaccatgttggccaggctggtctcgagctcctgacctcaggtgatctgcccgcctcaggctcccaaagtgctgggattacagacatgagtcaccacacccagcctaggtctcatgttaattactacaactgaggcccaggaattacggcattttaagtataacatataatgcttccaaagtaccaagtatatggtgtgacatgaggcaggctgttaataaatgttagctatttatataatttaggttgttcatgggtaacaaagtaatttccagactgaattcatctttgaaatcaactgctttgcatttgcataattcatatccctgtttttctatactggaagctaaaaactgtgattttctaatttgcaatgtcatgtagagataagtgggagataacttattctgaatgatacagttgaattccagaccattgtaaacagctgtccattcttacttaaatgctgtaaattttgctttttatcatatatttatattctaaagctgttttacatcagagagatgatatgtcaaccttgaaacatcactgtctagtaacaacaaaaccccaaaataagacaaaactttttattttacttcaggttggtggagaagagtttcattagatctactgggtatatggactctgtaggaacactgattgtgaggctgaggatgtagccagtgctgtgttatgaatacagaggaaatgggctcctgcatagcatggatgataatcaacaattgataaagaacctcagctgtgttgagaacttgaaataaactgacttgtgttggaagggaagccactgaatgcaaggctatctactgctagggagaaaaattacggcaaagtaatcattgtttagccagaggctaaaatttctgcaaaagctctgagataaaaattttgaataataaaggcatttaaatttaaacctcactagcacttcttcttaatcatacacagacctaataattctcataaaaacagaaaagttcagctcttcaccataccatggcaggtgggagacacagaagggggaaaagaatcataacacagggaagggaccagagacaccccacggtcattcctctaagaacatctcaggatgctgagaaattatcttatctttgtgaccatagacaagggcatcatttgaccaatgaccaaaatcatatctgtttctagatctcctcttgaccaaattaattgtactgtgattactgaaattaaaattcatatagatctatttttctgcttttgattgcagtgaagaacaataagcagcactaaattctgtctccgctttcctgctggaaaggaggaacctggcctgctaaaccccagctgagggcttaagccatgggcccaggagtggcagggaactgtcccttcagctccagaataatgagtcatggttgatgcaaataacccagaggagcattcctccagagatcaagacagagaggtaaagttgaagggtaagctaaaaccacaggcagtgtaccccaagcgaaaaaaagcttcagaagaaaaaaaagaggctgagacacaaaaggggggaatgaatcatggcacagcaaagggaccagagatactgcctagtcattcctctaagaatacctcaggaccctgagatttgatcttatctttgtgaccttatctttgtgaccattgaccttgtcacacatggtcacaaggataagataaagctgctcccacagcaggtgggaggccacaagcatttttgcatagaccacccacagctttggccatgaagggaagtagctcttaagggtactaggcctgctccaagatttactggataaaaacaggagcaagagaacagattggatggatggatggatggatggatggatggatagacagatagacagacagacagacagataacaaagggagagatgatagacatagatagttagatatagacagatgacaaagaaagatgacagatatatacagaaatacagataggtaggtagatagttgacagacacagatgacagatgattgacagataggtggatgataggtatatgacaaagaaagagagatatgatagacatagaaagataggtagacagatagatgatagatgacagacacaaaaatagatgacagacacagaaaaatagatgacagactatgtagatgactgacaatagaaagatggatgacagaaaaaagatgatagacataaatagagagatgatagatggttggtaggtaggtaggtagatagacacgtgcgcgcgcacacacacacacacacacacacacacacatacaacagagacaaaacagacatacaggtataaagcttctgagtttctgcattggaagggattttaagatgcctacctgataccaaagtaagaatcatttctctgctatccccaaccaataacgtactaactctgaggtcttcttccttctttctttattcttctccaagagaatattttcatggtcacaaagatcatccagtttgacactttttaagaggtgaacatagatatagagaagacagcaacttaatcaagctgtggcatttttcctgagcctctgttgactcagaggctttagtctttccagtaaattcctatgcatatgaatttttaaaaaatcatctcatgcttgcatgttcttggaaaaatctaagtccattgggtgattgttcaacaccattaagatgtcagcaaatcagtgggcaaagtttatgaagagacatttacaaaaagaagaaggaaatctcactaacaagcataatataattataacttctggagagtatgctggtgacaggggaaacagattgcagttgggactgtaacttggtggaactcgtctcaaggcaatttgagaacgttatcaacaacagcaaatacgtttatttccattgacccgggaagctcagcagtagtattatatcatgaggaaatactgataatatagagcaaagtattatgcacattttccacagggctatgactagaagcaaaaaaaatatatagttatataaactatggcatagtgtcacgaaacaataaaattttatagcatttagaagtgtttgttttattctaaatttaaaataacagaatacagaaatatatatatgcaatataatgtagacatttttaactagagaaaactgctaaaagaaaattcagtgaaagattaaacgtgagtatgggggatgcaattacatttttgtttctctgtgtgcaaacttttggcaattttgttttctttaacaagcatgtttctgtttttttttcaaatcgtaacatattagttttaaagaaaaactaggcttattatactcatttttttagatttctgtttcatcaaggggttactgtaatatcaactccttgtcttttctcctccaaggcaaaataattcttgcttattaaacctttcttcacaagtcttacctcccagctccttaattatatttgcgatttttatctgaaaaggtcgttaggtctttctttaaaaattttccaaacaaaattctgacatactagagagcccactgaatcacttatttgttgggaaattcttagagatatttcagtttaactctgacaatttcgcaatggaaaagaaaaaggaggccgagaggaatgacgtgcgcttcacagttttagaaaaagccaactagcaccagggccagccttcttagtttactctctttcatctacataacctgttatcaagtccagctcatctccggcttaggttctttgtgtctttgatctgctgaccatgctgggtcttatagttcagtaacatgttaaacataaggatcaatgaaaatatgcatacattgacatcttggcatttcaccagttttcagtgaaacaaacgagcaacacttttccttcttttgttccagatgtccgcatgccctccttattcacatacaagtaaggtgcagaaatgaggttaagcagagtccaacaagtcactcatcaaaacatgctggtgattgtcctgaaatatgatctcagactcatggctgaacataggtgtgcattcatgtttcaaggttttactaaaaaggtgaaacgtaaggcaaaactatgagaagggagaaggtggacctttccgccatcttctgctcccagccagggttctcctgtagctggaaagcagtgcttctctcagcccctgtcgataggaatccctgcttctcaagtgttcctctaagcagaggagaaaattaactgttgggattcaaaggtgtcccttctaggacacattgcctccatgtaaatcaaaagcaaaatgagccaactatgtggcagctcattccacacaagtgggcaaactttggtgtaagattaatgaaaagaaatgaaaaagacgtagcaagccaaaatacccataatacaattgaagcactttgcaaatattcctctatgtttttgtaaaccgaaagttgtctgagacaggtctcaatcaatttaggaagtttattttgccaagtttaaggatgtactcgtgacagtgacacagcctcaggaggtcctgatgacatgtgtctgaggtggtcagggtacagcttgcttttatacattttagggagacatcagacatcaatcaatatgtagaagatgtacatcgttttaatcaggtaaggcgggacgacaagaggcagaggctttcaggacataggtagataagagacaaaagattgcattcttctgagtcctctatcagccttgcactgaatacacagtttagtctggctcagtgaatctgcatttatcacataaacagcagggcagagaaagcagccaggtatgcatttgtctcaggcgagcctcagagagatgactttgagttctgtctgtcctttgtccgtaaggaattttcttgtaggcaaattgtgaggaaggtatgcagctttttatctttgtagctatcttatttaggaatacaatctgaggcaggtttctgacacagttcccagcttgattttttcccttggcttagtgattttggggtcccaagatgtattttcctttcacattttataactgtaacttttcaacgctgttgctaaaagtatcctttattatggaatattttctttgtgagctgtgaaaagacaaagttaaggcaaaatgacaaagaagggttacaaatgaaaagatgccctgatgctgatggataaatgcaagctggaagacagctgggtgacaacttatgtcaggtaaaaagggacacattgatggtatcaaaaaacaaaagaagattaagaacaaatatccataaaagaagaaaaatacttgtgtggtacaaaggaaaaatcaccccatcagattaggcaaatctgattaagagtgaaacatatgaatataataaaaatataaatacagttgtatcacatgaaactgctgttttggtaggtcaagaatagttgaatattggtaatggtttagcccaaagaattcacttagaggaggcatagacttcctgttgcatgtgagaattgagttcctgcaaaccagtccttttattattgctctaaactttccaacttttaaaaaagaccctgaggcatcagtgttggcttctcagagccccaggtgagtaaagcagaacagctgacattgtaagcaggcgattcctgtctggtagggccactagctggtgactcctttgttcagtacggagatggattcagctccccagctgctcccttaatcttcaccacatcccccttccaggccctacctggaagagcgtaaggtccctggctgtagggaaagggcaggaagcagagcagaactgtttctgcgtcaagcgctcaggagctaggagctgggagctgggcgcactgacttgggatcccaactgcctgggtctaagccccagctgtgcttctccccagagtttcctcaacatcctgtttcctcgtttagaaatctaagccacagaatcccatcttagtgggtcaagtgacccccaattgagttagcacatgcaaggtgcttaaaataaacagtacctggcacaaaaagaaactcaataaatgttcacaattgtgattttaatcttttgtgtggatgagtgcagttgcagaaaggaaaagctgggtacacataaaaacagttttaaaaaatgcccagagtacagagttatttacgctaatgtgttcacacctatggagaaaagtttgtagaatgaaaaaaaaatattttaaagatcaaatagagcaaagcaaccacagcaaatacttgtatttctctagtttcatcttcagacgttccccagggacacaggcaatagctccctcccctgcattagaaagatgactgtcaaaattaatctgcagtattaggggtagtgctgacagtttcatctctgtaaatgttattactgcattaaaaaaaaaaaagaaacccacaaacctctgcccatctttgtagtccaggcacttggagagttcttacggggagaagcacttctccccatcgatagaaattcaatttgctgcacaagttaagatgcagtaaacttgtctctcccttgctttactgctgctttcacaatcataaaacgagcctaatgtttaaatgttagaaagcatttaatatttaatcgttggagattaagtctctttcatgacgcctgagctgcccagcaacaggttagaaattgattgtctgccgacccctaggggcacggcagcagctcagctttcaacatctgcccccagctttctaaggctcagaaacgccaaaggaaatgaaaagtttcctcttccaaagcagttgccagttcctaggggccagcacatggcagcatctggaaaggccaaggggagatggatgtgtgcacatgaaaatgggtgatgttctgggacccaaatatctggcaacaggagaacagcagagccagggcctcagagaagctctctccactgtggccagggggagcccttgtgtccccacattcatgtgacgctacactagaaacaccttttttctgcccactggacatacattcagtgtcaggtgacctagacccattcacagatatctgctggcacttcacaccatccacattttttttcttttgtgcctgtcaataagaacagagaacacaggcaaaagaaagaaaggaataattgcttgctgtcacctattcagcctctaatagagccaattctgaaagaaaagaattcagtgctacttcccagcaggatgctgacaccatgaatgacatcatacagccagacctcaggcaaccagggagcccgcatgaaagacgagtgatgccaaggaagaacacccatggtgccacctgacagtcatgtcctgcaaagtggcagggggagaggaagcctgggagggcctgggttcaaatccctgctgggcccctctcccacagcctaatgttgggcaagaagaacctctctcaactcagtgtccttgttataacaacaggcttaggatgccttgatcccagggtggctgagttaaaactgtaggaaaaatcatttaggaaaaaccctataaatgtttgttaaaactggatctgaaatgagttaatcatcagaccccagataaaatcagttatttgtgtgtgatatggtttggctgcgtccccacccaaatcttatcttgaattcccacctgttgtgggagggacccagtaggaggtaattgaatcatgggggcaggtctttcccatgctgttctcgtgatagcaaataagtctcatgagatctgttgcttttaaaaaggggagtttccctgaacgagttctcttctcttgtctgccaccatgtgagacgtgccttttaccttctgcttgtgaggcctccccagccatgtggaactgtaagtccaataaacctctttcttttgtaaatttcccagtcttgggtatgtctttaccagcagcatgaaaatggactaataaagtgtgttatttggaacttcagtgttaaataaattctgtcatcatcaaatcccttcgtgggctgaagtttcttgaccttggcactactgacatttggggcaggataattctttgttggagggctgtcatgtgcattgtggggtgtttagcagtatcgctggcctctactcacaagatgccagcagcatccctccatacgccccaggttatgacaaccaaaattgtacccacatattgacaatttccttggggcaggaggaaaatcgccccaggcaggagccactgctatgtataatggaatgctaagaggaataactacaggaactattctttgctgcctatctgctgcatattaaacatagtgagataatagtagaattagaaagtgtccttttcctgatggttagtgataaccgttccataaagcaaatagcaaaaccaccccttgttcccatatctaaagtcagatctcagcctgctccagggacacaaacacaaagtgtgactgggaggacaaggcttatacttgaaaatcattgcaagattttgcttatttatatcagcaaaaaaccaagaaacatgcatgaggatctaatgatgttcgactaaggagcaggaaatgtaacactgagttggtcttaacattttaatcatggtgcattgctgagagattccagatttaatacgttattttatgcagatggaagtggctctaacacgtgactggttggctggctggctggctgaaattggaactcaatggtgaactgtttttaatgaggctgagatgccagaacttccctggaatactgtagaagatgaacccaaaggcttaggaaaatagaaatattggactacaacatacatgcacatatgcacacatacacacaaatacacacacatcactacattcacagagagctcccacagactcttcccgaggcatggagaagtgaggagacccccgcatcctgaagaggtctgtgccagctgctctctgtaggctggttatggtgacggatggggtcctagaatagcagaggccacatggcagcccttaactagaagagagggtgagcatatttaccatggggacagcaaggtttccaggaatgttttaatccgcaggaacctttggtggatgctaattgctcggagcatgccttggaagtaaataggcgggcagcttcctaaattgttcctggatctatatatcaaggatgaatttgcctctgctggtcagaatggagcgatggcccctcgccctgtttccaggctcaggacctgcaccttcctgtgggcctggctcctcccaaccttctcaccccagacttcttgcctcctgctttgttctgctttcctccattgcacacacacgtctccactggaaacaccttcttcatttctttaacaaatgccttctacacaggaaccgtcttggctttgggatacaaatgtgaacaaaacaaaaacccctgcctcgtggagcgacagcatgttttgctgattattgcagcatctgggatgtcatctgtcttgtttgttgctatgggcccagcactagaaaagcacctggtatatagtaggttcacattagataggcactgaatggatgcctgcactgtctgctcgccattgagtaagacagtctgtgtctctttcatggtctctctttactcaaatatctgtgagtcccagcattgcttcctcagttggatcacatcacagagcaagcttcagctatggtgagcatctctgtcaagtccatggatgaaatgcagagacaacccccccagggcaggagtctccaaaccaggatgatgatcagaatcactttgggaagctttgaaaaagcacagatccctgggtatagaccccagaatttctgactttccaggtctgggatggggtctgagtatctgtaaaagtgcccaggaatcttttggtgctctgctgtggtgcgccccgtctctgcacctctagtccatcctcacccttctccaggcatatctgtgggcccctggtttttttcccagaagccgagtctgagaaagatcaagagtatgtgggaaagaggagaatgaaggagcgaatagaatacgcctcttaaaatgtagacacccaatctgaacatctgcccctcatgccagccaagacagctcctgagccatattttttcatccctgatatgcgaagaaaaagctacaaagcaggttgcctgttatgcatacatgatgtgaaatgacacctcaaggtacagctttctgttcttcagcagctgaggttatcactgacatttgcctctgattctcatatccacagttatgaagatggaataaaccaggggttctgagagctttaaatgctggacagtacttctgctccgaaagcacaactctcctctgcatcaactcctagcaagcccaataaaatggattcttggatatacattttttaggaagagagtaagatgcaatgttctattaggaaaggaagctcagttccttaaggtcatcttcaacgctggaaatgattcacatttggaacactgacctcccgtgctttttctgaggtgtgtttcaacaccaacagcaggctaaaccaaacatctgaaatgcagtgagagctggatggttagaaggctctggtttcagacctggactaactggacactgaaatctgggctggagtacttattccagaagccgatggaaaaacatcacgttttaaaagtcaaatccttgactcaggatcataacatcatcagcatcgagcaggtctctgttatcaccacagtgatgaagcctgagctgcgcagccgctagggtaaagagggctctgtgctcagctctgtgaagacaaggaggcagattctcaagagcttagagctttgcacagctgcagagtgggcagggatgaatgcaggagagggagtgggaaagcagcacagacacggtaaaaggaaaaataatttaggctgatggaactctcaggtttccgacactcaaactgccatgtgaaaagcaagtggtaagaattcatatatgatatcagcaataaaataacatcctgttgtacaacaaaatacactgaaagacaacctttagtcttttataacgacaagcagatctcataagtaaatgaaaagctagtccattactctttttattccttaaaacaaaataaaaaaagaaaagctttcagtgacatgatgaaattactatcacaacactcttgacaatctccaaatagggaaggtgtgtttctacgctgaaacaggagaaattgtgcttgaggaatccaataagtacaaagtgactcaaagctctatcacagctgtcaataaagaatgaacagacaaaattcttcacaggcttaacatgagaggcattgagcgttttgcaaggctgaacaacagacgggtagtttttgcatgtgcagtgctgtcagaagttgtaaaagtaaacacacgtctttttttttttaaggtagtccattacaggtaattacatatttaaagtatagtcatttttcctgccttccatatttaactattcttatctcagtcattttaatacagaatacttaatgtaatcgatttttatatttctaggggaaaggaaacttctagcccctttgcaggccaaacccaatttggcttaccattctagactttcgtcctcccagaaggattctgaatccaactctttaggaaaatgactttgaatgggttgtgattacaagcaaatgagatgaaaagagtcaacgttttggactcttgctctccttgctaccttgtatttcagctgcataaagttccctggtgagattttgccacctatgtcattgattacatcaatgtgagctgcaggaagggtgagctaaactgaggactgtctgcacaagtgagatattcctcactcttcttcaatttaccacgaaaacagggtagctctgagcctcaaaaaagtgtagctcagacttctgggattcacattaactcatccaaccatcgagtttacatctcctgttcaatctctttcagagttctttatctgaatgaatggcaccaatattcatcttgttttttatccttcccatctttctcctctaccatccatttttagttattcatatcttattatcttttggtggtgactataaagattagggcatgcactcttcttgactatttaaactctaacatgaattaagatttttaccactatcttaatgttacattaactccatttattcccttatgttttttgaattgttgtcatgcattttaattctatatattcctatatattttagatcccaaggctttatcattttgtacagtcaatgttcatttatatttatcacttatgttgctcttcatttcttactgtatttctgtgtttctgataggattacttttattttccctgaagaactccattagaatatttttagtgaaggtgtgctagtaacaaactctttcagtttttatctaaaaatgttatctattcacattcactttatttttcattttattttatttatttatttatttatttattttttttttttttttttttttttttttttttttttgagatggagtctcacactttcacccagctggagtgcagtggcacaatctcagctcactgcaaactctgcctcccggtttcacgccattctcctgcctcagctcacatttacttttaaaagacatattcacaaagcacataaatctaggttggtctttcagcactttaaagcttttattctactgtgatctaacttccatcatattcatttagaagtcagctgtctgtcttatatttctaccttgagagcatgtgtcctatttttctctctggatgctttcaagggttatctctttgtcatttgtttttgcaagcttactttgaatttatccatattgagaatcacagtgcttcttgaatatggtgctgaatgtctttaatctgtcatttttctcttgaaatattacatattccctttcatcttctccttctaggaaaaaattatacatttattggtgcctttcgccatatttcacatgtttctttacttacatacattcagcattccactttttgccttgctgtagttcagcctggatattttctactttcttagtttgtttacaaattctctattctgatgtactgaatttgctattaaactcatatcatgagttgtaatataatttattaaattttttagttttagagattccatttaactctgttttataaatttcagttcctaaggacattctccactctgttattctattttcttgaccaaaacatgatgggaaatgcaatctctctgggatccttagcatccctttctgttcttgctggtggtgccaacaataaaaggctgtggccagtctacctgggccattttccaagactgtgtttgtagtcagtaattttgaggaataatgtaatgtctccctccagaacagagagcaagctttcttagtgtttgctataaaagcatgggattctctaaacttgatgttctccagctgtgatgcaaacccactgcatgtgtagcattcatctgagctatatagcattgcccctgtggaatttggaggccaggaggcaatgtgaatatgcttacatccatcatgtgctcgctgagccataagtaatacagttctttctttgacctagaagtctcatgttctcttccagcatttgtaaagcagtaacagattaacttatctgtaagtaaggtgaggtcaaattcccgaccaggaaaccaagcacaattattttaatgtatgtgtgtaaaaaccttcatcacttgtagatctgtgtctgtctctactgtcctttgttttttcttagtcctgttttttggtgtgtctcataattttttattgaaagtcagacattatctattaaaaaatagtaaagcccctggagcatgttatcttcctccagggaaggttcaacctatattctggtaggaagtctttctttctctcttttttttttttttttttttttgagagacagtctcactctgttgcccaggctggagtgcagtggcacaatctcagctcactgcaacctccacctcccaggtttaagcaattctcctgcctcagcctccagagtagctggaactacaagtgcccaccaccacggccggctaatttcttttgtattttagtagagaaggggttccaccatgttgtccaggctggtctcaaactcctgagctcaggcaatctgcccgcctcagcctcccaaagagctgggattacaggcatgagccactgtgcccagcacagtctgtcttttgaagcagctcaatccacccagctactaagctgatttgtggcaaagttgcagtttttacaagtttctatctctggcttatctctactcctagagtctagttttccatgggtcctaattggaagcctgaaacctttactgtttactagggcctctcctgcttggtaagtcttgacctctaattattgggtcataactgccttgcgatggccaaaatctcttctgtacttttgatagctttctactcagcttcttagtctcttgcccatacaatctaacaattggacaaatagcttgaggaagaaaaccatgaatttgggcttatttccatatgccatgctcatttataagaatctagcatctctgttctgcccatcttggacacttcaaattacaaatttttgctatccaaccccaggctaaaagttcagctggcttctctgccttttatgcaggactcttttcctgtcttttttaacctctcacttactgtaaattctctgagggaagaagtagctcacagaatgttggctcacctctctataattcttttccctctggattatttgtgattgaagtttttgttgcttcagcagttcttccatgtctttaatctgacttttaaataaatatttactctgtcttttctcattttgtggaaaagtctttggtcttccacaacccaaagtaccatttctgacatgcccttatcctttataaccagtacttcctaaatgtttctcacatcattccacttttctccatctcctccaccattaccatttcacttcttacctacagtatagaatatcttgcaactaatctatcttcagccacgattttcacttttaatctgttctctataagcaactatagtgatattacaacaaaaaagtattagtttcatatttctgtatagcaaggtgccacacatttaaccgtttaaaaccaaacaagtttactatttcacagtttccatccatccagagatgaagggtaaaccacgaaaaatataaagcattttcaggctatagacttaataaagaatggtagcctcaaaattcctctgtttctgaagtgaggagatggctgggtaccagaatatgaccccagtagcacaggaatccaagcacagtttagttaagttctctgttcagagtatcactggtcttcaacatagttgcaagctgggctacattctcaactgaaggcttcactgtggaagaatccttttccaaactcattcaggctttgcagatagacaaaaagctagagccttttgttggctgtctgctagaagctgccctcatattctagaggtttcactcagttccttgccatgtgaacttcctcaacatgcctgccctcttcatcaagctagcaaggataatttcttgctctagtatattaagacagaatcctacataatgtagtattatcattgggaatgacatctcatcatctttgcgtattctactggtgagaaggaagtcacaggttctacccacactcaaggaaagggaagtatgaaggatataaaccaggagggctgagatcatggagacaatcttagaattctgccatttttctattatattagcctcttcccagattaaaacccttccatggcttcccattgctaataggaaaaaaattttaatgacttataaattcctgaatgatctaaaccctaactctctatcttcatctcatgctatgccctcccttattacttgtattccagtcacatttttcagttctttatatttgccctattctttcttaccacagggccttctacattaattcttacctaggtcatgcctgttcattctttaagtttcaatttaagcgtgatttcctatgtaagtcttccctgacatatttaaacaggataaacctcattatatagcctcaaatacatcttgtttgtaatttcatatagtgcattcacttatttacgtgattatttggtttcagcacatctcccctcctagactataagctccataaaatcagatgctttctctgagtttggctccattgtatcctaattagctatgaactctatattctgcttggaagctttcagcatttttttaggccttttgtaatagatgaacttttctacaaaaaaagtaagctaatcaaagagctttctaaatcatctgattctataaaccagagccaggatgaaagagagtctgagaatgaccgtggcccttgccaggtgaattttcccaaagctgaggtctgaccatgatatttacatgatcaatgtcttcaatagtgtcaattgtcatcaaaaattttttacactccttattggacataaaaggccctctgtgacctggaccaaactaatgtttccaaacctatttcctattacatcctgctatggactgaatatttgtgtccctccaaaattcctacattgaagccctaatgcccaatgtgatggtatttggaggtggaatctttgagtggtaattaggtttaggtgatgtcatgggagtggagccctcatgatgggtttagtgcccttataagaagaggaagaaagagatctttctctccctccaccccacatgcaccaaggaaaggccatgtgagcacacagtgagaaggtggctgtcagcaagctggaagcagatcttcgtgggtattattggtatatttgcctgacagattaacatgtgttattaaatttaaaaactagtctgttctgctttatctcccccgtagaatctagatatgttgcatgcagtaaacatttaatgatatttgctggataaatttgttgcaagtgaaagtagtttctgggcaagctccagattcaaggcagaaaaaaaaatgttagtgctcttcagggataaggcagtcattcaatgtgtcttagttgtcaagtgtgaaaaagattcaaggtgccaagtatggtgcattaattcaaatgaaattgggccccaagtacttcagaaatatgacagacaagctagatatcatatcaggaaagcaaagaataaaggaaggagaataaaggctgaagccgtaatacaatgagtctatttgcaaattgagcctaaattaaggaccaagtaagagatgaagtgagaaaatgtttgcaaagtgtccgccaaatgcaatggattattagagtaattctttttaatttggtttactggtggacataacgattattgataatgtagtcaagaatatcttgtgaaataaagatgcacattctagggtaacagtccaaaacagaaacaaaaataacaccaaccaaacaaaaataagagaggcaatgtcaaatgccaaataaaatgtaaaggaataaatgaaaacatattattcatatattagcatgagcttgaaggtaatgtttcactctgagaccaattactacaaggaaggagatagaaaactggggcaataaactattttttaatagtagaaaaaggtgtgtaacacaaatataattagatgagatttatataaaccaagaaagctatttccgatgaagggctagaaaacaaagaaggtctttgaatgaagaaatggatacttcaacaaagaagtaacaagcagtatgcaaaagtttacaaagtcctgaaactttaagcaccactgactaattactgcatattgtttccacccatagggactatgtctttctgagcaagagaaaagtttttggagggcgacgacaatgtttcatccattctggtctcctcatagtctgggacaatgttctacacactggacaatgtgtccagtgagccccaggtcatgttgtctgtgtctcccggacacgctatttctatgcatttgtcttagaacacacttctcctctcttttggaataagttaaaacagacagaacagagaccatttgaaataacattcctacatctttccatcagtgcatgcacatctcctattaaaaatattcaacactcaccttctctgaatgtactttactcttatgagaactgcatttaggtgaaaatatctgctcatgtctaaaccaatccccaaacacacacacattgcacacacacacacaaactaagacaaacaaacaaaaatgaactctacttgtaaaacctgaaatttcttgaaggctcagaagttcaaaataacaatatttcaatatgtgcccctaagttgaccaattgaaaacaaaaccaagcccacacttttctaactcactaaccctttttatgcttccaacttatttcaattgtctccttacactttcttttgaaatctgcttttctttcaggtgtaaccatgggcagcctcaaagttgcagtctcaggccatctgccttagctgttcaatgtctcagttacctcattaactcccatgatctcattacgaactgtgaaaatgattcccaaagctacagcccagctctgacagctcaccctctagcaagtcccatataggcagacacttacaggaaaacttcatagatgaccctaaaactcacaaaaccttacacgctgaaatccaagttgatcttcctctcaacaaccttctcaaattgtccattgttacaaacagccttatcatattcatatcatattcaggttttgaccataagaaaatgtttgtacttcttctcttttgtcctatgcctgatcttacataacatggtaaaggggtctattttagatccttttttaaaaaagttctttgggtttcccccttttgatttttataaaattataccctcaatacctaacttctagatccctgaaacaatacacaaattggtttccttggccctgggttctctagctctagaccatctgtcttaagtcagtttcactaaatgcagaacctgagataggatttcttgttcatgtgatcaattgagggagtgctcttagaagaagagagtgaaggcagcaggatgcagctagagcaaaatactaacaaaaatatactctcaccagggactggcttgagccaatgtcacatggaagctttggagcatcaacgacaagccagctggagttggtgccaccttgagacaaagtgaccagtcatttgtaagcctttgacggtcggtatgcctgatggttgagttgtttcgcctcctagaaggttccattagccaagggcaactctccagagacaggacagctgtgggccatagccacactaagagtagctggggcctgggtgcaccagtagtggaggtcatctgggcagggcaccaactacttccccaacaccagtggttctcaaagtgtggtccccggaccagtgaagtagcatcatccagaaacttgtcagacacgcaaattcctgggctctacctcagacttactgaatcagaaactctggagtgggactggatcccaacaatttgtgtttgaacactccctccaggtgattctgatgcacactaaggcttgagaaacatggcactacaccatccaacacagaactcatgaatacttcttaagtcccaaattagtattcactgatcaagaacctgaagtaactcttatcactgcttctgtcagcaataaattccgcaggtttacaataaatgccttccatcaaattagatgccttctattcctccaaagacccatctcagcaacgcttctttctttgtaactcttcatcatcatggaatcacaggatattggaagagaacttgaaggttaattaatctagctccctcctttttgcaaatgaaacaatggaggcatccaaattgtaagcatcttaaccaagattatgcaatgggaactcgggtctccttatgtcaagtttaatgcttgttgttatacattatgccgattttactccaaattaagggtatgaagtttcaggtttgacacgatgaataagctctggtcatctattgtacagcagaatgactacagttaataataatgtattacatacatgaaaatcactaagagagtagattttaaatgttctcaccacaaaaaaaataatgtggaagatgataccatgttaattagcttaatttaatcattttccaatgtctacatatatgaaaacagcacatggtacactgtaaatttatacaatttttatttgtcaattatatatatatgttaataaagttggggagatatttttaaaattaaaataaatttaagaaaagaaaattcattacaacatagtcacagctaggtcagctctacctctttaaattggtgtttgtgtttttgcctgcaactaatatacctgcttaaccgttttttaagtctgtttccattacttccttcaggaaaccgtccatgacaggcatggtttatgatgttcctatttgtcaggtatctaccatccccttgacacttccatgagaagaatacgtttccttgccaatcaatgttggtcttggaaggcgagaccagaggaatgtgaggagctgggaggaaccctgagtgcacatggggcaaaagcacagcatttggctgggacccaaccctccttctctccattgtgaaaacaagtcccagatggagatgttcctgggatccgaactgaaaagacacatggatcagaattaaacctgaccccagcttagagtcaagcaagtctaacccagtggggccacccctggtccacagacccaggttgagatatgaatatttaaccaccattctgtatcatttgttaaacagcactgccacaacaacacatgttcacacacacagttcaaatgctggagaccaagcatgtttccatgcattggaaatacatgaactcacttaattaacaaccctatgaagtaggcgctattattaagtcaattttacaaatgaataccctaaagcaagagaagtgatgtaatctgcccaatgctgcatggctgtgatacaactagaccacccagctctgaaggtcatgctgtcctccactctgcaggtgacatttcaggcatctggacacttctgtgttcccccctcctctgggttcccagacttccataggaattcctgtagctttgcccttatctcatcatgttgaggtacaaaggttcacttgatgtatctcacctcctaggtggagaggctaaatactacctggtccacttaaagagcctgtaacaaggagttcagtaaacactggttaattgacaaactatgaagactcaaactcagctctcaggaccaagggctagtgctgatgctgtggtctcccaggcaagctcccatcttcctctatacctttcatgcatctgggggcagcacagctccatccctgtcttgactagctctcctagaccaaacactcacccagatatcacagctccccatgatctatcctcagcatatcttttccatctcctctttcatttatctcacagttcgtgctaagtcccactcaagcactccactgtctctcactcctatctgacatgaaagtccctcaactatgcatggtctattccaccctaaccacaggtgcaaacctttcccaccctcaaagcgcagcccaaacacctatcccctgggcgccccagctgaacatcctcttccctcctctgggctttaatagcacatctctgtggctttggtgtctgtgtctctaggcctatgacattgcttgtctacaaactctctatgtgtgtgcttatttctgttacttccacaagcctcttaaagctagggtccatgtcaaatccatctacattatcccaaagcacagaacacatgactttcaatttatggcaagcattcaataactatttccataatcaaaaagtgatggtaaaactggcttgcttttgtgaggtattattcactgttagcttgttctaaagggagctgggtgatggcatgcagcagaatccatcacggagggtacatcacccaccagctttccatctgcagatgttgcccattgtagagcagcatgctgcctgttcaggcactgttgccaaacagaaggttctcttggcagaagaactggcacatgctgggctctgcaggctgtgcccccgaaccagctcttccacattggcaaatgggcatccttgaaattgccctgccccatcccccacaggcctcctaccacccaaacagatgggcacacgtgtaagtatgccggggagcaagtgtgtacatcaggttggagctcctgataaaagatttgtctctcatacatggtatcaaccccgtccaaagagcaaaagcacaccactgtgaaatgggaggtgttgcaaaggaattgccttcatattctaattttgggatccattaattaaagagtcccagacctggagtgggagggggagaatgagaaagagctgaaagagaacattctgtttccctttaaagttttggctggtggcatcagtggacctggaaatgaatgttgtctcttttcaggtggagttcagatttaaggcatttttcaggagcagctaaatccacgacctgagatttctattgctgcctgcaagacagctggataaaggcagttctctcagggactagtatgcctccacacacaggtaagagtaaaagtttaataaattatctataaaccatgtttatagagagaatgatacactcaacatccaaacttattgataacctagttgcagtaatgtcagaatcgagttgaaaacctttattgactcaggttgtcttcattgtctgaaggcgcatgttggctagacaacaaagacagtggtgggagcagccaacatggcctttggtgtacattacaaatttaaaagcctaaaattgacaaagaaataataccacctataactctagagcactttaattctggtcttttttgagacactaaagacaaataagaactgcattgatccacttgatctacagatctcacaagtaatttcttctgctgggatttgtttttttttttttttcttttactttccaaactctaaaatatccatgactcatttggaacacaagaagtgcagcatgaacatcccagttggtcatctgcagaatatgccaaacagcacaggatgcggggaagccacataatggagaacagatcatcgtctggcaaagcaactgtccaatggccagcaggtggcccagttgctggaccaatatgctgcccagtactggaaggtgctcagtctcagaaatgggttataaatacccatacagggctgtgacatgtggaagctaagagccttaaagacttcaagctttgctggtcacactaggggcgtcaagtgcttctctgtagatagaatctatccagtctgtttattgtctgccttttaaaagtcactcctcatttccagacagcttcagatagaggcttgactagggattaaatatccatcattaatatggctcagagacattgaaaaagaataagagagaagagaagaagagtttaaatacctcctgtagaagggctatctcactgtgacagctctggatgtttcatttattaaacaatggaaggtatagtatattatagatgtgcttaaaaaatcatttacaaaggagaattactttatttttaatgaagaatcaagccttatcctctaggaggctttacaaaaatggttttgaagaaattaacctctaattttatttatttaaatgcatgtatttctaaagcttcaaaattattgaggtccactagttgttttttttttcaaagttactttagctagttggatgacttaactgtagatcacaagagtgtccaaacttattttcactccccagaatttttttcattctctcctgtttctgtcaggaggtcactatgttcatttgcctggtagcaggatgaatggcaaactcctggcatgtacaagttgaggaagctgcaatttgctccccctttctcttgaaggtcactaaatttaatactgtgattgaaactcagtgcctcccacaaatctccagagaactgtgattcataaggaggaagataatttggaggtgggatatgttaacctgtgcacacgtgttaagcaattataaattgtttcctttcatctgtctcagatgtaatacatagcaagactctgaagtataaatcctctttaaaatgagacagtcgggcaatagcccatgaggatacgtgggttcattcacaacactgatacccctgtacaacatcagatggtgacaaatgagactgattttcagcttggcttgacttgaactggtagcttctatctttggcttccttcttgcaggaaaaaaaaaaatatatatatatatgtctcatttagcccattggcatcattcccagtcaatgaatgagcatgacacttctcccagtaaccatctcaaagttttctagctgagctagttagtatagaaaatgttttggcactggaaaacagatgatagaaatcattgtttcacttggtgcacgggagagcagtggggaggtaggatatgcaggacaaagtagttttgactttgcctctcccagtccatgtaacctttgatatcccagaattggaatccctggatacacatgaaacacattaatgcatcacaggcaagcccaaaaattagggcttagtccaggaaggtttttggcttttcccaggaaagaattcaaaggtgagccagtggtagaagaaaacaactttattgagatggcagtgttacagcttcgtgactgctcccgcagagcagggctaccctacaggctgtgtcaagagcagcagctcaggcacagctcacagttaaaagtgagctcatggttaaactcacttttaattacatgccaattaaggggtagattattcagaaatttttggaaaaggaatggtaactttcaggacattgccatggaaaggggcagtaacttccaggtgttgtcatggaaacaggtggtaacttccaggtgttgccgtggcaatggtaaactgtcatggtgctggtgggcatgtcttatggagaggtactttgggtgcctcttccctgattcagccagtctttaatctggtccagagtcaagtcccacctcctacctcaacatgactgtatccctgaatacacaagaaacccttggcgatatctaggtcttctaattggggatgacaaggggagcatatacaggaataaacctttgctggagaaccacgcagtggctcctgatggggtgggaatgggcataaaagagatatgaggcagagtgaccaatgacagaggatcacaacaagaaaaggcacatttgagagcaattataaggtcaatgatactgagaagtgctgcacttctaaatctacctcccaataacatattggtctaaattgaaagggttcttcctgtttttaatcatacatgattttaatttaactcacacagtctccctgtactagtttgctagagctgctgtggtaaaataccaaaactagatggcttaaacaacagtgacttattgtcacacagttctgtagacaagaagtctaagatccagctgtcagcagggttggttcctttgaagactgtgagggagaatctgcttcagcctctctagcttctaaaggtttgctcgctgggatctttggtgttgcttggcttgtagacacatcaccccaacctctggctttatgtacacatgtcattcttcctgtgtgtgtctctctgtgcataaattcctttttttttttttaagaaggacaccagtcatattggattagggcctcacctgctccattgtgacttcatattaactaattacatctacaacaacctaatttccaaataaggtcacattctgagcttctgggagttaagaccccaacatgtaaatctggagggatgcaattcaacacgtaatattccctaacacaatatttccataacagtctgtagcgtcttcttcaggctaagggattggggcctcatctatcagagttgtaataaggaacaaaggttgttgaaggtaagatgagactcaagattcaataatatgttcaaactgcagaatcaaagagtatattgaggccaaatatctaaaaaagaaagtttgatggattgctaaagtaagaggatcagaaggaagtattaaaactaagataaggatacagaaagttgcaatactggatttgacataaatgtacaaaaaacagggaaggttaaataaatcgtgatacaaccatcaaaattaaagatttggtaagtattttctcatcccatgaataaaggcccattgatctttttgttgaaggatattcagcccatattaaccagggttgaagatcctacataaaaagatttgagttgccattttctcaaataataccctcagacactgactcttcataatgggttctgctagtacaactctgaaagtcttagagagaagtttattcattccattcaaaggatacttgtttcgagagcccccagctaaatttgggttctagtaccagaacagctagcaaccctgccctaatgggacatgaagggtacctggacatgggtgtttacagtgtacctttcacgggatacttcttttacttggcagacttcctaattcttacttgactgacttgcaatcagggagtccctcacataggaaacttgtttacactggcagatgcccttatggctcttatctgacccatctccagtttagtcctgcctgaccattgctcaggcactgggagcctgactttctagtctccctggcaacagggaaaatccggccaggataacctctagttctttagatggaaggtgcaaattcaatacaccatcacaataggaaataagtttaaagagtttttacttataggtcctaggcaaaggagttgacaatgagtcaagagtgaagctctccatcctcagtcatgcaggcagaaatggagtcaggcagagagagacagagagagcgtgcacacatgagtgcatgctctcagcagcatatataaaagaacagcgtatcagtcacttcaagtaattgggcaaatgcctgaatgatccctttaaagaaagcagaaggaagtgcagagctcagtctgccagactggagagagatgcctccaagtttttatctttggccactggcttgagccatttgagtatagcatggaactaaaggctgtgtcaatggtgactgagccctgcttctgatatgagaaagtcaaacttgttttcaaaatagatgctgatgcaagataaaatcataagtatttaccacaatgccttcaggtattagggcctaaggtttggttttgctttttggtttttgttttttgcttttcaatcctggttaagaagtgctaaaagatattatagccctacattctgattggtatcaagggcaaattttccttcttttacaatgtgttttctagttttttttttattttgttacaatcagcataaaggaagaaaagattatgcctttgaataagaattgtatttacattttactttttaaaaagaaggcaataacttgcatttctaacaatggtttattagaaccaaaccttcagatagaagcaactaagaatgctagataaaatatttaaaacgtctccttataagaatttaagaactgacagatagccaaaataaaatctaaggaaagctgaaatccagaaagccaagcacaagaaacttactctactttgacctgcagttacttgcctaccccgagaaattcctgctttgattctgcaatctcccttggatagcacaagatgcagaggtcaatgcccaggctgtatcccaagtggagacactaataggaggctctccttatattaagcaaggggagaaaaaaaaaggacaatgaactcatggttatagtgctacacataaactcctctctcacatctttgcaggagaatacagaggaagttgttgggccctgtctggagtaggtattaaaggaaaagaaagagtgttcctaccaaattatagacattagctacagcattgcctgggagatacagggatccacagattacaaacttgtttatggtcacccaagaccagacatacagaaacttggcagtagcaaatgcatattctctctatagagaaaattgtctattgaccttcaaaatattaccacaataaaacccttagacaataaactgcacacaaataaccaagcacacaaggaaagaaatcaccatgagtaaaatcaagaagaaacagtagaataactgaatcatacccacaagattacagtatttcaaagagatatctgcactcccatgtttattgcagcactattcacgatggtcaagatatggaataaatctaagtatccatcaacacatgaatggataaagaatatatggtatatatacacaatggaatactattcagccataaaaaggataaaatcatgccatttggctcaatggggatagaactggtggccattatgtaaagtaaaataagcccagtacagaaagacaaacattgcatgttctcactgattcatatatattaatacagaataaagtaaagtagattctatggaagcatagagtagaattgtggtaaccaaaggttgggaagggaagtgagaaggaggagatgaagagaagttggttaaggggtacaaaaatacagttagatagaagaagtacgttttagtatttgacagtacggttggagaattaaagttaacaataatattgtatatttcaaaatgcctagaagaattgcaagacaaagaaaagttaaacgtttgaaagaaaagataaatgtttaaggtgatggatatctcaattaccctgatttgattattatacattgtatgcaggtatccaaagggcaatgtaacccaaaaatgtgaacaactggtatatatggagcatcaggaagagtagctaatggatgtggagcttaataccaaggcgatgggttgatttgtgcagcaaaccaccatggttcacgtttacctgtgtagcatacctgtacatcctgcacatatacccgagcttaaaagttgaaggaaaataaataaatttaatataaatatttattttgaattctttatcaggaagtttgtatatctccatgtcttttgggtcagctactagaagattattgtgttctttgggtaggagttatgtctcgttattggttttttgtgtttcttgttgacttacattgaggtctgaacatttgaaaaagtagaggcttgttccagtctgcagactggctttgtcttgggggagcccttcaccagtcagcctacccagagattctgggtataccacctggtatggttcatgagcaggcttgctgctaatgtcctccagcaggctggcctgtttcttgggtcagcaggtgagcagaccctggtgcctgggtctgcaggtgccaacctggtgactagggccatggggggtattctagggctggggtgggcatgaagtctggggctgtaggggccatcccagtgctgggggtggtctggagcctagggctgctggggctaccctggccctagggtgggcctagagtctgaatctgtgggggctgacctggccctagggtagatccaaagccactgaggcccagtctggatcctggggctgaggcaggcctgaagactgagtctgccaggccggactggagcctggggctgcaggatccagccttggactagggtagtcctataggttcagtccagagggaccggcctggagtcttaggttatggtgagcccagtgttgggttttactgtggcaggcccagtgttggcatccaaggcaaagtgcagtgcttacttttctctcctttccccaagtgaagggtatctctctccatgccgtgctgcctgaagttgggggcagtgatgcaggtaatataaagctgtccttctcaccctccccagtgctactcataacatcaggatgaagcttacaaacaacacattgagtaaaaggagtcagacataaaagaacacattgatatgattccctcaatgttaagttcaagagcaggataatctaaactacattgtttagtgatgctttttataagagataaaaatatctttaaaaagcaatgatataattaacaaaatgtcagaacaaagattagtctctgggaggacaatatagaaggaaattgggagtctgacgaggctctgtttcttagactgaatggttgttacaggggtgctttctttaaaagtgttccttaaacaacagcttgtatagattgtatgcacttccctgtctgtataatataattcaaaataaaacaagggaaataatttgcaaaagaaaatgtctcctggatgtcttggacttagaaaataaaagcaagaattagtaggtagcagacaagctgtaagcaattttgcacagttgggtatacaaagtggtattggctgatagttttcacattccactcacggagaggtagatgggtttaatagctgtgtttaaagtgtcagatgcaagaacaatgataggtttcccttaaacgattttcactaattccctcccagctcaagaacttttttcattaaaatggtcctttgctgcctatcagaaacaattaaatcctcacctcatagcagtctccatcttacgtcaaccactccctttggcccccaaaatatacctccaatattatctaacacgaactggaattgccacatggtcaaggcaataaagaaataaagccacgaaagaaaccaaatgaaagcaaaggtataaaatgatttagatgttagtctgcagaaagaaaaagctgaaggaattagaaacagccacaggaactttctgtgaaccaggagaggcacttccatttacaaaccacactttgtttttcatagagtgggcttgatcatcacttaagaactgaaaattcagcattccttctaaggtgcattttgttcaaattgatataagtgccccagatggtttggcttatggtatcccattgattattgcgttctgctcttgcaagtcatagatctgttgtaatctaactgtctggggagtggccattattctagtttcaaacccattctgtcctcagtcacacgcattcaagcaaagtaatgcagggggaccagataaaagccgcccattagaaacctcagttgctgcttgcctctcccacagaattgaatatattactccagctatcgtcaacaaacatgcttcaacaacaggatcctcactgtttggaagacagcccctgagacccagagcaaatgggtcaaagtctcagttacatcagtataactacaaagacaataattcttacctctctcacaggatccagtgaaaaagtaagtgaataaaaatagactgaaaacagcaatgtaaggagctaaaagtactgtgtgcattgttgtaaaatattaagtcaacagtccaatcatttattgccactgaaagtctaatatcttatctgacaggttgtaaactttcagagacataagcttgaagtgtgtatgtttgtgtgttttaagtgtgaactgaagcaggtggcaataaggggaagaaggaggggaaatgggaagaaaagtaacacgaagaagaaatgcataaagaagagaccatgatccagtgggcaaataactcagttgaatctttgaagaaacaggtgtcaatgcttgttatcatggtgaaggtcaagtaacatttttctagacatttatctttactgctctctgctaggaatgacaccagcgcatcacaatactgccctcctagcctctcagcctgtgctgcctcccaccatggaggcacaccactgccattctccatttaccttccctcatctccctccccagctcaggctccttgcctcacagctcatctctccagactctgagtacatttcaaactgtctatggcaccaaataataagacaaaacaaaataggaaataacaagctaaagaatcaggtctaggaaggaagctccctttcagtcagaaccctctagtttcttgtgttacttcaggtcggctgtggatttgatgtgtaaaaggatgtgtggggaaagagagcagaaattaggaaaagccttcagcctgggatgtaggtctgatactgcggaaggagagagggatagaatattggagagcaagagtctcaaactgcaggaaaaaatggcttggccagacctatgggcagtccttaaggcaaagttacccactggagagctccatgtcatgtctcagtacccatctgtgctcagccactggatggctgcagcctgcagaaaggttggtcgcagtgaaaatgtgggagcagttaaaaagggacacaggtggggccatttgtgcttcctgcagcaagacgatctaagcagcagcccctcaagaaatatgttcctttacctattggtcacctgaaagtaagggccttttttttttgctcactccatagcatagaagttgcaaactgactgtaatggacaatctgggaagatgaggtttttttttttttttgctattgcatttgggtattgaatagtgttttaaaaacttttgagctagtgaccaatatttaaaacaaatagattttacatttttaaaattcacacttccagcttttcttgaaatgaaatgcaaagggacaacattctttcacgctggtggaaaaacagccttcccccttagtggacattcactctgcagctggccgtatttcccaccattcctttatgcctacaccagcccacgcacggatcactttactgactgttctccatgatcatttaaggctttaagtctcctgcattcatgcctgtgtcaccattagaacataatatcactgacggcaattattttgtctgtttggatcattgacaggcaattaattgcctgcaacagtacaagttacatattagctgcccaataaatatttgttcaataaaatagggtgctatcaacatagagtgttggaagaaattgagtggatggtggtggagaaaaggcacttgtttcagagtcttgtctatggttagctttgcactacccacacacaaccaaactggcacctaagggagaaggtgagactccagacacagcagtagagggtgcttgttctaaggaatatgtagaatcaaggtggtacagaatgggtgtgtatacagcagcaaaaagtctccccttgcatgtcctgtaccctctcgcaggacttctttactctcctttcaaatttaggatgagggagtgggtttgtacagagaagcagtgcttatctcagctcctgccctagccccagctcagcctgaagcattgctacaaaatactcactgggtcacattccagggcagccaggcatgaggggtcctcaccccagagctaacgcacacttaagcataatggaacgaattgagttcaatgatgatgcgatgggtgatcctcaaatggcataaaaatgcacatggacaaatattgcaaatcaaaccgagaactgctgccagaggccagtcccccgtggtgtctcaccagctctgaaaatgattaccagatgataaagcagagcaggctccctgcaatctgattacgaggagggactggcaaatccattaggagcaaacaggcctccttcaagtccattttacttgctaaaatcaagcaacgttaagtttaaaaaaaaaaatgagccaatttttcatcccattctcattgcctcatagtcagtgcattcgttttcagttaaaagagctgggaaggtttgcgctttgagagcaaaccttcctgctattaaaaatcaaagtcagacgtaagcctggcatgaagcagagagctagtacctttagtttgtgggcaacctgttctgacagcctaacctgcagaaaagcagccgtggaggaagggaagcaactctgaccttctgtgcatcagaccgcacagagccctctgcttgtgtcctgtcacataattccctattccctggataaggagatttataaagaatccactaagttagaacaggaagggattttagcacttgtgtaatctacctttctcttagtcttatttcgttttatgattattattattattttgagacagggtctggctctgtcacccagactggaatgcagtggcgtgatctcagctcactacaacctctcccccatctcttgccccctgggctcaagccatcctcccagctcagcctcccaagtagctgggaccacagacatgcaccaccacacgtacttaatttttctgtttttagtagagagagtttcttgccatgttgcccaggctggtcttgaattactgagctcaagcaatccacccgcctcagcctcccaaactgctgggattccaggcatgagccactgcgcccagccttagatttattttaaaaccacatcatcttttaataagcataaaaaatgttcatgtcctcgaaagatcttgacatggctggctccagctctaccccacctctagcttgagagtctttttcttgtacacttccagtagccaacaggtttcagagctttgtattccatagagtacatgatggaaacaatgaaccattttccctgaaatatgaaaatataatatcatattaaatatgctttgaaactaaacacttccctctaccaccatcaccacctatcaagattctgatacaggcttcgctgacttggtttggccctctcatgttatacagaaagcggctgagacccaaagatttttttttttttttttttttgagatggagtctcgctctatcgcccagactggagtgcagtagcgtgatgatctcggctcactgcaaagctctgcctcctgggttcacgccattctcctgcctcagcctaccgagtagctgggacgtgggctcccaccaacacgtctaattttttgtatttttagtagagatggggtttcactgtgttagccaggatggtctcgatctcctgacctcgtgatctgcccccttggcctcccatagtgtttggattacgggcgtgagccaccgcacctagccaggcccaaagattattactgacctgaggctgcagacttgcttttcttcctaatgctggaacctaaccccgtgttccctgactcacattagattgctctctcagtgctcagggctttatactccaaacccagggcttcatacatgactgcccaagaacaagaggaaattgtgaaaagtgtctttgaagaggatcatataaacagtaatcttttgtattggcatcatttggatagtggtgttgggacccaagggtgaacacacccctccccttcaaaagttctggtcaataaagaacactcagaggacagtgctccttgggacagttacccaagtaaagttcaggtctgtactcaactaatggctaagcaattctccaataaccaccagaggatagggctctcgggtgaaagctagattagaaaatatgacctagagcttagaccaaacatgatttttaaattctgaacactactcctgctatgcccataactgaatacaagtaggccaacaaaacaaaagaatggctacttcttctggggttgggaagagggagccctgtcctgctctgctttcctcaatggagcagaagctaagtgcatatttcttcttgaacacacacctgagaagcagtcaagaggccctgctgtgcctgagtgtggtctacctatgcgtaagaggtggaggaaagagatggaacatgttcatgccaactttcccacccgataggaagaggtaactttagcagaagtttcccatctcttcttagaaggtaaagtagcctggccgggtgcagtggctcatgcctgtaatcccagcactttgggaggctgagacaggcgggtctcttgaggtcagaagtttgagaccagactggccaacacggtgaaacaccatctctctcaaaactacaaaaaaaaaattagctgggcatggtggcatgcacctgtagtcccagctacccaggaggctgatgcaggagaatcactggaaccggggagatggaggttgcagtgagccaagatcgcgccacttcactccagcctgggtgacaagagctagactccactcaaaaaaaaaaaaaagaaggtgaagtagcctatcaccataggctacttcatatgatgatagagtgctctatcatcatccagttcccatacacaaaaaattaaacccattaatggaatggtaaaaagtacattctttattgaaccagaaactgaggaattccagagattggaagtgacagggtacagctagagaaggagacttcagcctgtggcatgcaggaagaccctctggaaagggagacagaggccacaaactgccccataaccaagcgagggcactagcttaaggctgtgatcacaaggccaccagcaagtggtggtgactcagcaagctggatggttgacctcctcatatcttctttcttccttgggtcagggagcattacaggaataaacacgtccatacgggtggatgaaataaaagcaggagttggaccagagataagtgattatggaggctgtcagaggatcactctggctgctgagtggagaacagtttatatgaggtgtggagggggagcaaggaagccagtgggtgtggctgcagtctttcaggagatggagctaatggtgtcctggatgagggtatgaatgaaggaatggagagaaggacacaaattctagtgatatccaggatgtaaaatcaacaagacaaagtcatgggtcaagtatgattttgtatcccactatgcctatggattcacaatacaatgaccttagtacacttccactctatttactcatcccttataatttttgctcttcttctcatgtttgtagtgataatgtatgttaaacatctcaatgcattatttttgatgtttttatagtcactattcatttcatttccattttctgttggtcttcctttcagcattctgtgtttttacctgggatcactttcctctgaactgaagaactccctttgctgttttctttaacacaaatgggctcctgaaaagttctcttagttttgacttttctgaaagtatttcttttatttccactttgcttttgaagaatgttttgctaattaaagtaaaattctaggttcacagttattttcttatatcactttaacgagattattcaattgtgttttgactctcattgtttcccatcacaagtcagttgtcactcttcctgtttcctttcaaagtcatctgccttttcaacacttctggctcctttcaggatctccttttgtgtttggtgttcaaaaatgacagtgatatgctaaagcatggttttctttgtatttatcctgctgaggctcataggccatgattttgagtcttaatgtcctcccaaaatcttgaaaaatacttgcctatgattatgtttctgttcattttctttctcctctctttctggaactacaattatacctgaaattcaatcttttcattatgacccatatatctcttacttactcttctatacattgagactttttatctctctgtgttttttaatatctctctggacatattctacagactttcttccagtttactaattctctctactaccctaccatgatgcccattgattgaaatctcaatttcatttatttttatttttccattataggatttccattggaatttttatggtttctggttctctgctgaaatccttcatcttgtaattgtatttcttgaacatcttaattgcgagtatttaatatccatgtacaataactccaatttctaattgtctatgggtctgtttttactatctgtatttctcttgtttttggacaaaccttatttttttgtacacctgttttattttcaaacacaacattgtcaaatgttgtataaaaaatgtagagacaatttaagactttgaataaggttatcactctccagagagaaactaatttttcctctggcaaatcactttttttccgtctgggactgagctgattagaagttgtttttcagtctttctgaggaatggcatgtttccagttcacccttactcataggatataggccttaagcataacaaccaaaaacctgcagtaatcacaggacttctccttagaaggtcattcactacaatttttgtccctctatccttgtgagactacaaagaactttgcttataatcttaacttctcagatgtcatttttgttttctgattttgcacttgccttctaggcaaaagcagctccaaatgccagacacctctctttgtttccctcttttttctgtatcttagccccagaaatgctcattgcctgagcagctctttgaagccttcaaatatgtgtctatacctgtgtgtatgtatgttctatattttctcattattcttcctgaatccaaaaccacgtggtcagccaaaaacagaaaggggcaaaagatgatgcatgggtttgtttctgacttgcttaatagattttataataatgacattcaccattacagggaattccagaaaaggactgactgctgacaagattggttcttggctggcatctgggaacttacatttcaggagggtttctgctgttaactgataagcaccattcaccgagccaaaagtatctgtgaaaagaattggtttttgttgaactcctgctttcctgctgggaatctgaaattgcatacatgccagacacagaggggatatatattagtccactctcatgctgctaataaagacatatcccagaccaggtaatttataaaggaaagaggtttaattgactcacagttcggcatggctggggaggcctcacaatcatggtggaaggcaaagaaagagcaaaggaatgtcttaaatggtggcaggaaagagtgtatgcaagggatctgctctttataaaaccatcagatctcatgagacttattcactgtcacaagaacagcatgggagaacctgcccccatgattcaattacttcccactaagtcccttccatgacacattggggaatgtgggagctgaaattcaagatgagatttgggtggggacacagccaaaccatatgattctgttcctggcccctcccaaatcttatgccctcacatttcgaaaccaatcatgccttcccagcagtcctccaaagtcttaactcatttcaacattaactcaaaagtccgcagtccaaagtctcatctaagacaagtcaagtcccttccaactatgagcctgtaaaatcaaaaacaagttatttacttcctacatacaatggggatacaagcattgggtaaatatgcccatgctaaatgggagaaattggcaaaaacaaaggagctacaggccccatgcaagtgtgaaatccagcagggcagtcaaatctcaaagctccaaaatgatctcctttgactccatgtctcacatccaggtcattctgatgcaagaagtgggctccaaggccttggggagctccactcctgtggcttaatagggtatagaccccctactggctgctttcacaggctggcattgtttgcagcttttccaggtgcatggtgcaagctgttggtggatctaccattctggggtttggaagatggaggtctcttctcacagctccactaggcagtgctccagtggggactctgtgtaggggctctaaccccacatttcccttccacactgctctagcagagattctccatgagggccctgcccctgaagcaaacttctgcctggacatccagacatttccatacatcctctgaaatctaggttccgaatcctcaattcttgacttctgtgcactctcaaattcaacaccacgtggaagctgttaaggcttgggtctggaactctctgaagccacagcctgagctgtaccttggccccttttagccacagctggagtggctaggatgcaaagtaccaagttcctaggttgcacacagcaggggggccctgggcctggcccaggaagccatttttccctcctagtcctcagagcctgtgatgggagggacttccatgaaggtctctgacatgctttggagacattttccccattttcttggtgactaacatttggctcctcattatttatgcaaatttttgcaggtggcttgaatttctccccagaaaatggggttttcttttctattgcatcattaggctgcaaaatttccaaacctttatgctctgcttcctcttcaagctttgccacttagaattttcctctgctgcataccctaaattatctctctcaggttcgaagtttcacagatctctagggcaggggcaaaatgccaccagtctctttgcctagctatagtgaccttttctccagttcccaggaagttcttcatctccatttgagaccacctcagcctggactttattgtccatatcactatctgcattttggtcaaagccattcaataagtctctaggaagttcaaaactttcccacatcttcctgttttctgagccctccaagtctctaggaagttccaaactttcccacattttcctatcttcttctgagccctccaaactgttccaacctctgcctgttacccagttccaaagtcacttccacaattttgggtatctttacagcagcgttcaactctctgcagtatcaatttactgtattagtccattctcatgctgctaataaagacatacccaagactgggtaatttataaaggaaagagatttaattgactcaaagtttagcatggctggggaggcctcacaatcatggcaaaaggcgaaggaagagcaaaggcatggtggcaggcaagagagtatgtgcagtgaactgccctttataaaacaaaaccatcagatctcatgaaacttattcactttcatgagaacagcacaggaaaaccaattcccatgattcaattacctcccaccaggtcattcccacgacatgtggagattatgagagctacaattcaagatgagattagggtggagacatagccaaactatatcagagtacctatgtgatcagcccccaataaaaatcctgagcagcaaggctctaataagcttcaataattgatgtttcagatgtattatcataattcattgctgaggtaattaagtgcatcctgtgtgactccactgggactagattgttgaaagtttgcacctggtttccccatgactttgccctatgtgccttttctctttgctaattgtggttggtatcctttttctgtaataaatcatagccatgagtatgactatatgctgaatcttgtgagtttttctagtgaatcatcaaacctgagcgtgatctttgggatttctcaagatagaacaactagagtggagaaaataataaatttagacttggacatattaagtactctttatattacttgaccttttatttatttgttgttttaccatgtacttctttagttctcaatctttcaacagcattagcatggttgaccacccatccttctggaaacatgactaagcctttttataacagagctatcacctggtttacttcttacctctcttcctctgactcccttgcaagtgcatgactttagattcttgggctgtcttctattctcactctgttctctctatattggtactttcatccacattcacagcttccaacacctcctacgtacaaaggattcacacatttacagctttggccttggtctcccttttaggctccataactgcatctcaacagcctatttatcttccagataggccagagtaacctcagattcttggtcatgccggcattcttataaaatatcaaaacaagtgctttgtttcagagcaccttctctttcctcacacttttcttctaccctcccatgaaaaggtatacatcctttgtctctgtagtcttagctgtcacatggtatgtctcctccctgtctatatcctttgatttaataggttcatccaataagactttattgaacatctactatgtacattaggctagacactggggatacaaagatggttaaaacatggacccactcttcaaagacttataggcaaataaataatggcaaacatagaaataaagtaccataaagtattataaatgtgattgcagagcagtatcaggacataatacgagcccccaaaagggtaagtagtccaatcccccagaaaatggaggaggagatgctggaactgcattttgaaagccaagtaggtgttctccatatggataggatgaatgagaggatcaaatgcacactgcagggagggacacatcatagtcactatgatgatggaaatccacaagagaaaatgtcatgaaagcaaactaaactaacttaaaatgcaaggtagtaattttctcaaaatagcatttatttgaaaacataagtaccagaagaatataagagatttaaaaaaagaactagcattttctacagttttgttacataatgcagggtttgaatcacctaggctctggatcagcctgtctctgttagatctcatgagaccagctggtgttgcccttcctgtcaataacagcaaaagacaagaaccaaggtcagtctccagggcacaatcaggagaatgtgagcaaaagggattatcagaggaaatcttaaaaaggagagaattggattaagaaagccaatgaaagatccaagttgaaagggcaggatcacctccccagacaattctagatgattacaggcaagatagactaccagtttgactatgtcctttccaagcttggcgagaaaacagttgtcatttcagaggctggctgcattcatataagcatcatattttcctgtagccaatgccataattactattcacaggaagatttggatgatgaatgacttcctggtaccacccaaatcatgccacagtgtccactctgtctgatccaattgtcatccctggacacagacgtaaagccctcagccctggctcgccagagcaatcacagagtttctccttgtcctccccaactgcacacactcggatgggggaagcctgttcaccaagagcaacagtatctacaggaggaattttaccccagatttttctctcttcatgcataaaaaggtgccatctgaaattatctcatctgtccaaaatggtgcccagacaaggggagaacagtccattgatagctgtcattcagttcaataactgtcaagcctttttttatgaataaggggctgcactagttgccattgagcattttaatatatacaagaaatgccctgtccaaatcagaatacaccctgggaaatggacaattcaacccaagtgtcataatttacctattgctagcaaacacaatgatcaaagggtacaactctgatatggacatatgcccagggcagaaaaagaaaatcaacagaaacaaattgattgcaaataatcttgattcattgctaatttcaaaagtgtagattttattacataataaagttatatatgggcataaatattctattatatagttttatctctagatcaaaaaagtaactttatttatgtatacatatttttgctcccaggcttataaacttttgcttttatggtatggtggtcttaaaaattaaagcaaaatattatctgcaatgtttcccaaaagtttccgtgtgattcagagagctcaacaatgatgcaacagcaggcatatagacatagcaatgcaattcacacccagctatttaactttttattttctagactgttatgattggctggattggaggatgaattctccagagcagttcacaccaacaaagagagaatcatatctgtagccacagcttctaatttttataattattttccccttttaaaaaaacccctttgcttaagccagtgcaaaaaaagtaattcaaaaatcaaactatttattataatcactgtccacccatcactctgggtagccagaatgagtgcgctggaaatagatatttaattagatatttccaaacagccctcacaccttttactttccactgcccttacaataactctgggatttttaaaatctaaaattggaatatgatacatgaatgtaagtaaatatagatatgcccagaaattaaattgcacctgtgaatttatcctacccttgggctactaaccaaagattctttaggtagattaatagtttaactctagcacatgaagaaatgatattttaattaagtttggggaaataatatatgcaggcaaaagataataaccatactctgtcaggtataactacattgacttgaagaaacagtgcatgtaatcctaaaattcgccagtgccctgtaatcattaatttttccattaattacattaatcattaatctgtcagacatgctctggcctaataataattgcaatcatttttttgaggatttagggtgcattagaaatggttctgagaacttcacaggcagacatcaccactcaggtaatcttcacaacaacctggtgagggagagctattttgattttccttttacatatgaggaaacaaagaattaaagaggctaaataacatgtcctgagtttaaacctaaccagtggaggtcctggtgtctgcatgggtgcttgctgctgagacccaggcccccacgctgcactaggctggcgctgtccactgacgtcctcccctggcttctctcggtaggatattctccctctctacgacgggccctggggaccccagactgacagtgctaaaaggctccctgtagagttcatggaaccccaagcatctggtctgatttctcctggccccacacaggggtgccccatatgaggagagcagaagaaaccactggaagaccaggcctttttttttttttttaacctcttctcgtattgcacagaatatttcaaatatttgaaatgtcaccaaaattcccatatcaacctaattcacaacagcaactgtgataaaaccaaagtatcttacatcctgagtgggagattaggaatagaaggaggagaaataaaaaagggaggggacgctgggctcggtggctcacacctgtaatcctagcactttgggaggccgaggcaggtggattgtctgagcttaggaattcaagaccagcctgggcaacatggtgaaaccccgtctctactaaaatacaaaagaaattagccggtagtggtggcctgcacttgtagtcccggctactcaggaagctgaggcaggagaattgcttgaaccctggaggcggaggttgcagtgagcggagattgagccattgcattccagcctgggcaacagagtgagactctgtctcggggaaaaaaaaaaaaaggaggggagggaagaggacggggaaaaaaagaaaagaaaaggggagggtaggggagggggagacagaaagaaaagagagagagagagagaggaagaaaaagagagagaggaaggaagaaaggaaggaagggagggagggaggaagagaaagaaagaaagacaaagtactacatggagtgagttggagtttattttaggacatcaaatatatctttacaaattgaaaaaattattgcaaaagcaaaatatacaacataaaattttataatgcattttctctacatgcaatattttaaactatatcctttatttttcctggcttggtggcagaaatttgccaacaacttttctttggaagaactgctctcgcttgagattatttctgtgctactttggttttcaaaactcctttattttataaaattatagaaatagtaggtggtgctagttttattgtttgctttcaatgtcctatatggcaaaggaagatgttagcaatcaggaaaaactgttggtatggttgtcttttgaaaaatgtgtagatcctaaaagtctagaaattcctgcattattcttcagggattccttagcatcttccccctccagccaagactcagggatcctatttcattttctgggtaagagtggaatcccaaagttttactaagagctcactctgctatctccttcaggtggcaagacattgctgccacagggcttttatatttaattatttttattcctgatccatagttttagtatgactcatgttaggtgtgaatccccgcgctacaggtctttcttgatacagaggtgaaagtcccagacttggagccccaagtcctgggtagagatgccacctccactctgtctgagcaataactccatctctttcaacccatctttttccttttctcagtcaagaagaaagatctttgtagaccacatggtgacctcccctttgcctcaatcccatcaacttctggtctttaagccaaaccaattgattttaaacttcccccaaaagtaatgcagatggacatcatccctcagacctgggtttatgggcattcttataataagggtccttctgaaacctcttcttgtgtgcttagggagcccccataaaagagatatggctcttctctgattctgtgaagtctcaacagggattgaaattaaataaaatctactgtgtgcaacagggtactgacagacttcatggaagagagaggaattctcaaaattaggaggcagctaggcatcatttccctcctccatttgattgcaaactcaaatgactttgggaaccaggcagggaaaatcaatgagggagcgggcaggagccaacaggggagtggtcgggaatgtggtggggaactggaaagggtatgtcctacctacagacattcatattcaaatatttttacaactcagcaccagccaagtcaaataaggctgccagctgaattcagctcctgtgcttccatcttgcaacttcaggtttagactagaaaaagaaagagtcttggagtcttgtctggggagacagacatttatgagcttggtccaacctgtgccatatgaaaggaacagcatgcagacactcacagcagtgaaacagccatgcggatctgtgttcccacaggttcatcacacagtacgaaatcccacagcctccccgacaaacctgttttgggtttggtcagggagaagggagatctggtgcactactggccagcattgaccattctgctgaaatccccatggagttaccacaactcaatggctcagatgtgtggctgcgctcgaatgggaggagggatgtgtgggaaagtgggttatgaggattccccaaaagtgagcagcatctccctccgagtaggttagaagcaggaggttacagtgattggcataaactggacaaatacagtgagtcctgtggggagacaccttggtgagtcccggaaaaagtgctcatgaacttctttggaaagggtttaatctcttaggtgctttctcaatgacctctggagactgtcctatttaatacctaagatcaacctcttcatttctgcattgtaactcccactttgccccatgtcttcagagaagacatctacatacccaactatggtagagactggaaacttaggccaggccttgccccacctccagagtggtgtcctctcctagcatctgcagcccaggagggacaggagaagtctggtagcccctgaagagcagaaacagctccagaaggatgagggcctggaactcacgagcccagctacatgtttcaggaagctgacccctgacaacaaatggaggaggaaaggacgacaaaccaaaaaaaaaaaaaaagtttgaaaggtttaaatatgtagcaatgtcccaaaagggcaaccaacacggtggctgcattcagaggacacgtgaggcatggcttagagtagaacccaaagacgattcctgagcttgcttctttatagtgtcattaaaataggaattccaggtctttctgcctcctttccccctagttatgactgttgaaggccacaattgttctcttgcgaatttggctagaaaactcatccttcacagaagccacatgaaacattttgtctaatcctaaagcaaaatctgtcatacccgagaagcacagtctttctcccattctgtttgtaatgaacattgcctttgctggtggggtttttaaaaaatattattattaaataaaaccttgccaaatgtattttgcagaagtatcttttatggaaaacagatggaaagagctaacctaaaaatgcaaatcgtaacattataatgacttcttaattttaaaaattatgaatacgacttcccaggagggactaaaagagacagtgacaacagctgcagaagaaacatcaggagtgggaggggactgcaaggccaaaaaggttgtctagttgcagagattacaaagaacattccttgtctttaaatgcagtgtgctgagcactcacgtgttcgattccaaagtgtttattcaggtaaacgaaaggaatgaagaaaccaccaatactcaagatgcaggttgctccccaaagtgtctacacatgccacaaggaatataaagttctagaaaaacacacttaatgtgtttcctccccactttcttcatggatcatcagacaggaatatgaaaccacagtttgcaaatgcttctgattcgtgtatgattactcaggtgttaaactcctcctgaaatgggcatttaacacagaggttccttatattttcacaactggcctctcttgaaacccactcttcaagaagattgaatgtttatgcattttcttattttttagaaagtggatgggttttctccccaaaccatgttttccactcttgaataacccaccgtcttcttccttccatctttctccttcttcctttccagaaaaagaagagattttagaaaactctttctatatggaaaggaaggagaaatattttcaagattttctagcagcaaattttaatattgcccctgtgaatgaaattcaatacacatacaaattatgcctctttctccccttcaattctttatactttttgaatagcaagtcaccaaaggtactcaaatacacacatgcagtctcccaattaatacatttagaagtaaatccaagaagcaatctgtcatcaattgtagtaacatactgtctccaatatgctgctctgggcttcctggcccatgccatatcagagtattaagtgctgtctctgggtaaatggttgactcacacgtgttctgagcggctctcatctcaacagagccgagagaaattaaacagctggaagcattttcaaatttctgtctgcgaactgcttaatgtatcagaactcaacatggatttcccactgagacagaagtgtaaaagttgttctttcttcttcctcttcttttttttgaaggcatctcctttcctttcacaaacagaatatcaagcttttcaagttctcaccataggttagagaaaagaaaaggagtcttaaaatcagtgatcacctcctactggagaaattgatcaaaatctcactggggaagaaagtagtggaggaagacagaaatggggttgtagctactatttctctctcctagaattaaacataatccactaggactggctccactgaaagcattttgactgctatgtgtggagaccatgagtcatttgggggctctcaatgaattcatgggttcagaaaacaaacacagtcacctcaacataatataatactattcagcagagaataaaatgcaatataaaatggttcatcttgaacaccatccagggtgttttgttgttgaagtaccaagaagtccctcaatatttctctgccttagtggagtaccgtatttccttttagattctcctccccacacttagcacccccgcccaggactgtgtcatagagtatagttccaggaggattcatcctgatcatctgattgctttccctcactagagccttgggctagttaccagattcagcattcacgagcattcaaacagaattggacatccagcaaatagaatctgacagcatttggaagtgaaccacgaacgcttgtatctaagcagcagctgtctgattacttagatgatatgattcttctaaaagttctctgtctttagtttggggttgtttttacttaggccatatggtcacttcatttttcttggtttgcagctataacaattacagtgagctccaaacgtagtaatcatgtatggggagagacaaggaggtcagctgggcttcctccaaatgcagtttgagagaagctttcagaatctagaggcatccatcaacatctttcatacacaagaataaaattgtacaaaactgtgtggatgttgtaggaactgtgtcaactaagctgagctaaaagcacatttcccagaattcccttccctgtgtggtcctgagtgagtgctggccacaagggatgttttgtatgaggtttggagtgcagacataaagaagcaactctatctccttccaccctgaaggccagtgagtgcagggtgccaggcactacagagttcacgcctaccatcactaacttccagcctcccagaaggtgtaatggagtgctcaaacctgcagctccttcagtttccacagcagggctgggactatggtgaggcaggtgaggaacttgccttggggcatgacaattaaagaggcacttagtagtcaaggcaaatattttaatgcaatgttctttaaaaatcaaagttaatgcagaaatacacatggtgaacaaactatcaacatatttaatacacaggaacagttacagttctgggatgaaccatattggagctagaagcaagaggaaaaattaataacactaatctcacaggtctgtgatctccttcttcagtttctctgatccctgggtgtcaggaacacatgcatttccatgatcaagggcacctgcctctcctgcaggttgcccacatggaggtggtgagggacatctgcaagctccagtttgccctcttgggatccagttcttctcgtggatcccagtttgtccatacttctccggacatctagctgtcctttccaactatcattctggtagacctatagcaacctcatgctcagccctcgacgcaagacaacaatcagcataggcagctccagcagcacccacatttgcaaggcctaattttaatttttataataacccccatactttatacacttgttgtggttctacttctctgacccataaagatgcctgacccatagagatgtgatgattatatgcaaactagaatataccaatgaggcatcaaacacaaattttgtgagaggtacgatcaaattgtatggtgaaatgtctacagctttcccccagcctgtttgaaccatcattttaccattgtcaagatgttgccttgtgttcctttgctaaatgactagaggctgggttggcagtggggtcaattgtttataattgataagagaacagataaccaggctatccttatgtttctgtgaggacagagatgttcccctgcagggtttgcttgattttcctttatcagcaataaagacaaggttacaagcccctgaagaagccatagagtatgcttaacatactcgagttctacaaacccaaaccccattgaaggaattttaaacactattgtgtttaaaagcaccagttgctaagttcagtcatacataaactatacgtaaagaggaaaaatatttacctctttaaggaccctggtaaaagtcctaggttatagattagtctctgagtaatcttctattgttatgctgagctctggagctggctaaactggagagtgaggctctcacacagtctctggggaagacacctgcttcctaaggaattttggctcagtttggatgaactatggtacatcagaaggagaaagaatttgttcctgaggcttcctaggagaatagctgggccatagagatgaaaacctaagtacagttaaacctaagattaacaactgcactgttcaaggaaccattctctgtcgtagatctagaccatggtttctcaatatcaacactattgacactgttgtgaaataattcttagttatagaggggctgtccttcacatttctgaatgctcagcagcatccctatcctctatcatgtagatgacaagagcaccaccagttgtgacaaccaaaaatgtctccaggcatttccaaatgactcctggacagcaaaagtgtccccagtgagaatagccatgtagacaacaacagacgctgggatactaattactaaaggcaaaagcagggacaaatcaatgtcagatattgggagatcagagttagataagaatgaatcttggtagacaaagtaaggcagaattgtagacaagaagaagcccaaaaccaagtcaataaccagagatgccatataccagataaaagtcatgtcagccatccctcctcactgggtggggcctcgctgcaggaatttcagcaactccagccaggggtttagggacagaactctgatgtccctgggactgagcccctggggaggaggaggagccacagtctccgtggatcagcagacttagtctttcccactgctggctctgagggatccaggcagtctggacaaataggattcccccagtgcagcataatccttccaccaaggggcagccagagtgccccaaagtggggcaacttcagcagtctcaggatacaaaatcaatgtgcaaaagtcacaagcattcctatatacaagcagtagacaaacagagagccaaatcatgaatgaactcccattcacaattaatacaaagagaataaaatacctaggaacacagggaatacagctaacaagggaagcgaaggacctcttcaagaactacaaaccaccactcaagaaagtcagagagaacacaaacaaatggaaaaacattccatgctcatgaacagaaagaatcaatatcatgaaaatggccatagtgcccaagtaatttatagattcaatgctattcccattaaacaaccattgacattcctcacagaattagaaaaaaactacttaaaagttaataaggaatgaaaaaaggcccatatagccaagacaatcctaagcaaagagaacaaagctggaagtatcatgtgacccaacttcaaactatattacaaggctacagtaaccaaaacagtatggtactggtacaaaaatagacacatagaccaatggaacagaatagagatctcataaataagaccacacatctacaatcaccttatcttcaacaaacctgacaaaaacaagcaatgaagaaaggatttcctatttaataaatgatgctgggagaactggctagccatatgcagaaaattgaaactgggccccttccttataacttacacaaaaattaactcaagatggattaaagacttaaatgtaaaacccaaaactataaaaaccttagaagaaaatctgggcaataccattcaggacataggcataggcaaagattttgtgacaaaaacatcaaaagcaattgcaacaaaagtgaaaattgacaaacagaatctaattaaactaaagagcttctgcacagcaaaagaaactattatcagagtgaacagacaacctacagaatgggagaaaatttttgcaatctatccatctgataaaggtctaatgtccagaatgtacaagatgcttaaatttacaagaaaaagacaaccccattaaaaagtggccaaaggacatgaacagacacttctcaaaagaagacatttatgtggccatcaaacatatgaaaaaaagctcaacatcagtgatcattagagaaatgcaaatcaaaaccacaatgagatagtatctcgtgccagtcagatgattattaaaaagtcaagaaatggctgggcgcagtggctcatggctgtaatcccagcattttgggaggccaaggcggggatcacttgaggccagtaattcaagaccagctaggccaacatggtgaaaccccatctctaataaaaatacaaaaattagctggacatggtggcaggtgcctgtaatcccagctacttggaaacctgaggcacgagaattgcttgaactccagaggtggaggttgcagtgagccgagatcatgccactgcactccagcctaggtgacagagcaaaactcttgtctcaaaaaatataaataaattaattaataaataaatagtcaagaaacaacagatgctagtgaggctgtggagaaataggaacgcttttacactgttggtgagattgtaaattagtttaaccattgtggaagatggtgttgttattcctcaaagacctggaaccagaaatatcacttgactcaggaatcccattactaggtatatacccaaaggaatataggaatataaaccattctatttaattattattctcaaaggaataaaggaatataaatcattctattaaaaagacacatgcatgcatatgttcattgcagcactattcacaatagtgaagacattggatcatcccaaacacccatcaatgatagactagataaagaaagtatggtacatatataccacgaaatactaggtagccataaaaaggaacaagatcatgtgctttgcagggacatggatggagctggaagccattatcctcagcaaagtaatgcaggaacagaaaaccaaacaccacatgttctcacttataagtgggagctgaacaatgagaacgtgtgggcacaaggaggggaatgacacacactggggcctgtccggggtacagggggagggagagcatcaggaagaatagctaatgcatcctgggcttaatacctaggtgatgggttgataagtgtggcaaaacaccatggcacacatttacctgtgtaacaaagctgcacatcctgcatatgtatcctggaacataaaatttaaaaaaataaataaataaaaataaaagtcaggttagaagtcgaagggaagtcaggctcaaatgaggggaaaacaagatgaccaacctggagaacctggaagcatacatggatttcgtacacatcaagaatttggtaacagttattggagagtttgagcacctgaggaatatatcactaatatttaaaggtaagacaaagattctcagtctttccagataaaattgattttatcagttagctattgatatgtaacaagcttcaccgagaattcagtggcttaagcagtgagcttttttatttttcctgagtctatgggtctgctgggagatcttctggttctggttgggctcacacatgcatctacgatcagctgtgggtccagtggccagctctgaggctctgagccaggctttctcaagtactttgggtaaatatcacagaatacaaatttacaatactatcctagtccattttcggctgcaaaacagaataccgcaaagtgggtaatttataatgaatagaactttgtttggctcacagttctggaggctaggcagtccagaggcacagcacctgcatctgttcagccatcttgtgaggaccttcctgttgcatcttcccttagtggaaaggagaaaacagaaggacaagtaaacatgggagacagtgagaaaatcgggctgaacccattcttttatcaagaaactactcctgtgataactaacacactcccaggataacatcattaatcccttcatgacagtggagtcctcattgcctaaacatcccttaaagtccccccttcttagggccaggcgtggtggctcatgcctgtaatcccagcactttgggaggcggaggtgggtggatcatgaggtcaggagatcgagaccatcctggctaacacaagaaaccctgtctctactaaaaacacaaaaaattagctgggtgtggtggtgggcgcctgtaatcccagctactcgggaggctgagggaggagaatggcatgaacccaggaggcagaggttgcagtgagtggagatcgtgccactgtactccagcctgggcaacagagtgagactctgacttaaaaaaaaaaaaaaaaaaaaagtccccacctcttaatactttacaatcacaattaaatttcaacatgagttttggaggagacaatcaaaccacagcagataccttttgatcttaactgctacattataaaacacaagttactattatttattactaaagtagcaatctatgggaagtataatggttagattctgtctgtattgtcaccccaaccattattatgctgtcagaatagccagcaacagcagtcactcttggcaacactaatttattcctctcagttaataactcttatttaaatgttagcttcaaaataactttgacctttttctaggaactagctgtttgtccaaaaataatcatctctttttatatacttccttttgcctaaattgtactttttgttgtcacataaactcctgtgattcaaaatgttcttactttctaaattgacattcactctcagtcttaaattaatatttcagcaaatgtaacaatagaacaaagcactagcatttactgagtgtctactatgtaccaggcactgtcttaggtgctatacataaactaactctttcaatctgcacagtaaccattttctgtagacaaagaaactagggtacccaaaggataagtgactcgcccaaggtcactcagccaatacatgagctgggattcaaaccccagtagtctgacctagaacccatgtttctaatcaatacactattgcctctgtaatgttgaataaattatagcaatacaatttttattttttaataattattatgaagttatgatttctttattaatggaaagttaaatataagtacagccatgtggttaaaaaatagaagatttgtgatcacttagaaattcaaagactgctgacttggctaatcagagagaatattaattcctttcatttgccttatacagctatcactgtaggcaaaatacaaattatttagtgtaatggaatccaatctctagctataataaaccataactttgtttctgcaacattgctctaattgactctgatcaaacatttttcagttatgtggtgttgttaagcttggaagttttaacaaattgaactaaaaatgatataagtcaggggggaaaaagaagctaaagtatgagaagctacagtttttatcaatagttccataccagcatctaattaagatgcaaaattatcctttaaaagaatgagttaatcaattaaaaattaatgtgggaggtgaacaacggccactgagtcagaaagttgggtgtggggagaatacatggcagcaaattaacttttgagagaaggaaagtgtttgtgtgataaatgcatataaaaatataaaacatatataaaaaaacaaaactcgcacagtgatcatttgaaaactcatttgcaaataaatgagaaaaaatatttgggggaagaaacttcaataaaattattagcaccatcaaagaaatggtttttcatagagaaaggatattaagaaaactgagggtggtgcatatactgttacaagcttcaaatatgatttttttatataattctttttttttttttttggagacggagtcttgctctgccacccaggctggagtgcagtggcacgatcttggctcactgcaacctccacctcccaggttcaagcaattctcctgccttaacctcccaagtagctgggactacaggtgcatgctgccaagcccagctaattttttgtattttagtagagacggggtttcaccgtgttgcccaggctggtctggaacttctgagctcaggcaattcaccggcctcagcctcccaaagtgctgggattacaggtgtgagccactgcgcccagcattttttttttttttttttttttgagacgagtctcactctgtcgcccaggctgaagtgtagtggtgcaatcgtggctcactgcaaactccacctctggggtccaagcaatcctgcctcagcccccctagtagctaggattacagttgcccaccaccatgcccagataatttttttgtatttttagtagagacggggttttgccacattgaccaggctggtctccaactcctgacctcagatgatccgcccacctcggcctctcaaagtgctgggattacagatgtgagccaccgttcccagtctatttttatataattgttaaaacaagcttctattacagtttaacacctatatgaagacataaatactatctatacatttcaatgcgtaatcagaaagtggtgggaggagagtgaggatcaaaaaactgtctattgggtactatgcttattaccttggggataaataatctgtacaccaaacccccaagacatgcaattaacctacataaccaacctgcacatgtatccctgaacctgaaataaaagttaaaaataataataaactggaacatctacgtaaccatcaccaaaggtaatggcgatggcccttaacaccacagcacagcttgaccaccgccactggaatgttctcatccttgtcttttggtacaacatatacccatttcttttgggaatggaattgctggagcataaaaaataatatgtgtagtcacttacatggagactaccaaagtgttttccaaagcaattgtacccatttatactctatccacagaatctgagtctctgttgcccttattcagatgtcattttgattttaactaaatgacaacttgatcacaccacatagtaataatcatatgcagttattaattatattgatctttgacatcatctattcaccaactggtatgaaagtatttcatattataacaacctatacaaccatattagtgcaaagttgctgaatataagccttgtcttccactataatgatgtcaaatgactttcaaatatatctcacattttagctcaacaaattccaagctatccttcccagtttcatcagcactctcagcactctcatcaagcagaaatgcaaatctttcttcctgcttcccctgctatcttcacaccttagtcccttcactatctgcctgttgagtttttctttgacattcaacacacgaggctcctccaccacctatgtatcacacatggtgacccaattctcctgaaccacactctatcacctgtcactcacttattcattggctccaacaatagccatttgtgccacatttaccatgtgcttgttaccaggctgccactaaggacaaaggcgaacaaagcatggaccctgtcctcgaggagctcacagggagaaacagacatgtcaatgaacaagtgcaatctgttataataagcataactagaaaagtggaaaaatagatggacataacacaggcgtaagaaagcgaggggtcaatttgcctgacaagaaaagacaatggatagaattttgcgtggaatctccaaagctaagcagggtactccaggaaagcaggtggggagtaggcaggacagcagggccacaggagcactcccatcaagaccctcccagtcctatacagacctaggaactcagtaccaggtttaataaggagccccgctgagagcaccagggaggcaggcagctaccgaaagggggttggggcttgcaggggactgctcagggtacattttctggttgcctcttttactctgagtgtaggcccccatctgcaccatgcccttcctgcccagatcctctttcccctccacccctcacatcaggagtagctttgtcaagagctccttcactgctcagccctctcacgggagctgccatggccgctgcctgactctgaaacacccctgaagccctccttttctcctcttactctagttctactagaaagccttaacagtcacaaagagtgcatctccaaaaaaaattattcaaccttgcctacgttttctctgtcaagtcacttccccaaagccccaaagacttgaagtgatctgctaattcccaagctcctacgaaataaggaaaggcttctgctatcccggacccaacacagcctgctgaactattttaaaaattaatcaatccgtaatgcatgtatgaagagccttctgcctaaagcacgcagattgcagggggagcatttcacagggtggacccaaagctgtgtgcaacggtgaggaaagggcatgctgtcattcccccaaaagtcccagatttcacaagcttacagtctgattaggagaatagacatgaatcagatttccagaaataaacagcaaattacaactaggataaatgctccaaaggaaacatccatggtgctaacagtggacagggaggggatgactcacagaggaggcaagggtgaccacatgagggtgggtgggggaggagtgagcagtgagaggagcccaagcaaggataatgccaagatagcagaagacagatggcatcttccaggaagggaaattaggtgaatgtgatcaaaatgaggcatattcagagaaacatttcagaggggatgaggatggaggactacttaagagttatgcagaagcctgaaggccaacttgagcatttaagatttgagtttgcactcccagtaatggctaagtatctgctatgagagcaaccattctcagactatttcttaaaaacacccttaaactatacagacctataaactcagtattagatttaataagcagcaccagggaggcaggcagctactgaaagggggtcggagcttgcaggggaatgctcagggtacatttctggttgtcttcctttactctgagtgcccccatctgcaccatgctggagcagatgaaaatgtgcagtcttactgtactgatgatggagggacaggtacggcagccctagtaactgaaaggaaagcaggatgtctggtagggagaaggagagtcccaaattctgtggatggatcctgctcatgtatctggctgacgtaggaccacacatgcacagggtagactccaggcagcccagctatggctaaaaataccttttgggctgctgtgatccactgggaaaatactgtttccattttgagttaagctgttgagtttacagttgaattaaagcattacagcgggggttttttgctcactgttttttattggtggcggggggtaaccagatttgcatgtttgcattttcagatagtgcttctgactttattgtgtggagcagattgtgctggggcaacagtgatgtaaccagacatcaggaggctgccaaaggcccctcatgtgagaggtcatggagcctcacaggactgggtcagaaggggcagagtctgaaagaagtggataccaagtcatcagagctggggtggggatccaacccaggctgacgaagcaagagagccaacaaggactccgtggtctcagacctgaaaccagaatagccatgacatttgtgatgatatgcaagctgggagaaagaccaggcttggtggggagcgtgagtggctttctggcagcagagtgtaaggtatattgagataccaagtaaaatgtcgggtgggctgattcacacggaagttagagagcggtcggggctaaagatataaatctacaagacaactgggtttaaggagtaatgaagctgtgggtgtgagtgggatcccctaaggataaaatatagggtaaaaagaaaaagggactcgggatccagccttcagaagaaatcccacagttttcatgaacaagttgagttggagacacctgcagagaagctagaaaaggcaaggtaaaaagaaaccagaacctttgtgttctctcaaaaaggccgcctacgtgatggttaagagcataaaacttctgacattctataagcctcaattcaaatacttcgtcaatatgtccacccatgacctcacactttcctgctctaacacttaaccctgatattccccctagaacctactactcctgcctagcccttcctcctccgcctcacatctcagggtcttgcagcttctgtaggtcccctatctgttctcactttgtaatcattattatcttttctcctccccagctttccaaccccattatatatatcattgtagggctcatgttgccatcctaaagtaacaaagactattacacagtatccttaaaaacataattttacagtctgatttgttctcttaaaagggacataaaagagtatttgaaatcagcaagactgaagctctacaaagactgatattttaaacatgtaagtgtccatgtaaactaatcatttttagtgggcctcactttacattatttgtttccttttgtcaattcgatatttaaatgactgactagtgaaatttcttgaccctgtttttaagggccactgtgacctacttataaccacgtgtcaactttaacaccggattccaaaaacaaggcacaatgtgagatgaaatgataatcaaagtggattactggaggtttgcttggaatcctggtcttccatgtggacatcgttttttggggacagcatctggggcttccttctgctaccacaaccatcctcaaagtatagtctggagacctcggtaggtgcccatggcctttttaagggtccacaaattcaaacctaataacatgaagtcattatgtggcttttaaaatctcattctctctctagtctacctcagagttttgatacagtatcaaagaagactattcataattatctaaaaagaaagccaacattaaaatgcatgccccttttccagccacacatctggaaaacagcaaatcacaacagactgaatacagaagcagatgtaagcaggcatccatcttctattaagcaggacgttaaagagctatgcaaaaatgtaaaacaatgccaatctctcatttcatgttctttcattttgggaaaaaaaaattttcataaaaagatattgttcatttagcatgtaatagatgtactatttttgtctttagtgaattattaaatactttttaaatttaattcctaacatggtaagtatctgccaacataactcacataagcaaagctctttggggccaggagacacatgagtactttggatcccatgcacagagtatgggttccaaaggtggctgggggagggctcagcattggccctccctctgctaagcctgcttgcccacaaagtgtacctacttctaggtggctgctatgaccccagaatccaaaaagtaaattgagcaaaagcccccagcccacagtgtttcctctgcccatataacatgcctctcattctctgcagatggaagcccagagaacagatattagaccaggactcgtattacacccagtacccatcagggcagttggacagtggctagaatattaaagaacttctgtaccccaagccaccaaagcacttcatgaccactccagctcctgcccaacaactcacaatcatacttgaccccttctgcaaataaaagggatagagcttggcaggctgaccccagtgcatcctacctaaccacctctagcttccccaggaccccatgggctggcccaagccctcccctccctcatagcccaccttaggttctgctctttttcttatatatttaaagtttcacccttccccatcagaacccatatgggccccaacacacacaccccaaccctctccctttattcctctccccacaatccctttgacccaggaggggcagatttagggggttttatttctttactttttatcctcttcctaatgtagagcagccagcctcttgcctagatatcaaagcagaagggccatccttgtaggctgcagaagacattctgatctgagtacgctgggctcagtctttgaaatgccacatgaatttcagatctactcttcttcccatgccatagcctaacaactttattactagtttctcaagctttgtagaactcttgcccccaaaagttcctgggggttatcatgtttttcttcccattccttcctttccaattacatcattttaaggccagtgattattagactttgcctcaccttagaatttcccagggaacttcaggtgtctagttgagctggtgtccaggttgagccctgaaccaactacataacaacctcaggatgggacccagggttcaagagtgtttcatgctctctggagatgccgctatgctgccaagactgagaaccagttatctaggctggatatttaggcatgtcttcttgattccctgcacttgacccccctccactgacccatatttagaactgtctgcggaaaagcgcctcttatgcccattctttccattggaacttcccctccctgaatgaatgggctgatagaagaagcaggctatgagtcaagtacaagagtattacactcaaaacaaacaaaaaaacaaaaaagcagcccttcttcaagagacacaagcccatttctattcccttatcttttcacagaccaagtatccctgcattcatttgcccttgtggtcactctcaggagagtgcagggcagatctgaccactgatcatgcaccagacaaagccacatgtcccacaaaagaacccctggaagctttataaactaccaatgactgcaccgctaccaaaaccaagtcactccagctttctgggatagggtcctggcagcaatatttttaaggttcccccaataattcttacatgcaaccagagagaagggctcagggaatctttgcaagtccagccttcttccttcttcccctacaaatatctgggtgatgtcttggttgccccagctttttttttttttttttggagacagagtctcagatgcccaggctggagtgcagtggtgtgatcttggctcagtgcaatctccacctcccgtggccgggctttctagtccatgttttcttttgtccattatcttgtatatcacctgggccacctgtgcttctgtccatgagtctttcagtctgttctgcctcattccaaagcccagcccagactcctatctccgacttcttcgctcagatggttgttggtcttaaatgagaagtacctagagcccaagggatgacagcactcattcaactgtgttttctaattgggctggtcaaacggtccacttcaaaattttttttaagttagtaaatgccttttttactgaaaaagtaatacatacttgtaataaaaaaaattccaacagcaaaagtgtattacaacaacgtaatctccttctacttcagttccctatcccccctctcccctcagagagaaggacttctatgcaaatacctgttcacttttgtacatctatcctgaggggctggtctactttgcagaaacaacatagattcttgtgatctgtctactgaataagactctgtgggaggaaaaaggaggaaggtcccatgaatctacctttaaagactgctcaggtggtcaaagattggatgggtgtgagaactgctgccaaaacacagtacctaacatggcctttaggcttttagggaacttggaaatatgataaaaagtgaatatatgttgaccctacgaaagttcatctgttaaagtcctaacccccagtacctcagaatgtaactgtgtttggacatgaggtctttaaagaggtaattaagttaaaatgaggtctttcccatgggccccaatccaatctgatttgtgtccttttaagaggaggaaattggccagacgtggtggctcacgcctgtaatccctgtactttgggaagccgaggcgggtggatcacttgaggtcagtagtttgagaccagcctggccaacatgacgaaaccccgtctctactaaaaatacaaaaaattagccagccgtggtggtgtgtgcctgtaatcccagctactcgggaggctgaggcaggagaatcgcttgaacctgggaagtggaggttgcagtgagccaagatcacgccattgtactccagccgtgagactctgtctcaaaaacaaaaacaaaaaaaaacagaagaggaaatttggacacacaaacagaggcagcagggagacacacacacacacacagaggaaataccgtgggaggacatggcgagaggccagccatctgcaaaccctggaggaaggcctcagaaaaaaccaaacctgcagacaccttgatcttggacttccagcttccagaactacatgaaaataaattgctgttatttaagccatccagtctgtagtaatttgttatgacagcgctagcaaactaatacagtaagttagttctatcctggtcacctagagatgctaaggaaggctataaacagatttatagacattggagactcctaaaatgaggtcatcagccccaaggccatggggcccctttgcaggtgaaaccacttcacagcaggtttctttgtgtggttcagttggtaaatttttggccaagatacaaagcaaaggttgccttataccaacttctacccagcatagtgagaatgaggttttcaggctttctggatgaggtttagcatttctctaaaatttaaaacatgaatgccagaaagtggtacacatacacatctaacataactggagaagaccatgtggtggtagggaggcttcctgatgaacaagtatagctgcaactgacaaagaactgtctgagtagcccagtgcagcaagttcagctcactctctaccttataccaaaggcctcggctttctcatgcctaagcacatgtcactgcgtgtgtgtgaaggggggtgatgggggagaaggaagggattaaggcagtatggcttctgcagaagagctgggactgcaaaaccagtgccttctgatggaaagccaacacatgaggaggagacacctggtttcttcctgctttgaaagtggacctggctttgatcaataagctattacaaatatgatgcacagttgtgagagaaaataacttctgtttcagaggaaatggcacagatgaagggaccgccattgcctttgaaagtcaataccaccccctgtagtgatgtagcagccacagccatatgcaatcactgtggctgagccgggcagcaggcagtctgctgattactggaatagcgctgcctcaaaaagcctgcagaggcgaggcttccttttgaatcagtgcaatggtcaacagagaggtctttcttttttcttttcttatccttttctgcctaaactctagaagcggacaataaccatcagagatctgttctgttacaaatccaatatatgcagtctgcccttctgggcactctatcaacagatctgccccagcccaccaatcttaaatcacactgtctacaatgctctcaaaaatattttatcacagacagtgcaatattctgtgtgtgcctttccactgaaattataattctagaggcatcagttgccctaataagaaacagagagtccagctgtaatctgatggagttacagtcaagaagccattgctttgtaaagctgatatgaacgcatctgaatttcaacctccaacctgtactgtgattattagcacatccagggttagggatgggtctttactggtgaaaatagtggcctctaaaatttctatgatgaatgttataactagcttcttagtgtgaaattaaagctatccaagatatgggtattggtgaaaatattttagagttaccccaacccttatacaaggtatatggatcctgagagacctgttagcttccccgcctccccaggcaacttgggtctagccaccaaggtgagaggtttctgcctatcagagggtgaccacaaaacacagagaactgggacttcacgaatcttacagaactggttggattatctctcgtgtcttttgctaatagtatttgtttagtaaatgtccatatgggtagcagaatttggtttgggactggctttctttaaactggcatttgaggttacaggagaatggctaaacctcagccacctttcattttttggaggctacattttataccaaaaagaacctaattggtttaggtcagtttagaaaacgtatccatcattattctccagacgggctgaagctctgcgagccttgtctctgttacttgtcctcccttctctaaccgccgacccaaaccgccgacccaaattctagacctccctcagggttcagccacttgaagatcatttccacttgaagaacactttctatggaaagtattcctcacctaatggctttactttgtgccccaaaaacaagggctaaagaaatcacgctagactttatccactttgccatgcctgtttggcaatgttgtttaggtcttaacacttcatgcctatattctaagtccttgcaaggcaaggacctcatttgccacactagttaattattttgtatctccccaagcaataaatccaatcccatgaacacagcaggacttgctaaatgcacccactgcttctgcatctactgtgtgcatgacaactttggggctaagaagggagacaacaatttggctccgatccccaagaagtcatccaggagaagagaatgaatgtcgatggttcagagaggcaagtctcttagcctctgcactcaagcattttaccatgaaaacatctgtgttatgtaatttctagggcaccaggaaaaatggctacttacccagaagactaaggatgatcttaacttttcctccagctaattatttaaagggatgtaacatgaggttttcttaaaacaaaacaaaacaaaataacagctagatatggctgggcacggtggctcatgcctataatcccagcactttgggaggccaaggtgggtagatcacaaggtcaggagttccagaccagcctggccaatatggtgaaaccccgtctctactaaaaatacaaaaattagctgggcgtggtggcgcatgcctgtaatcccagctactcgggagtctgaggcaggagaatcacttgaacccaggaggcagaggttgcagtgagccgagatcacgccgctgcactccagtctgggtgacagagcaagactccatctcaaaaaacaaaaaaacaaaaaacaaacaaaaacacctagatttgcaactggtgtgttcaagttaacaatccactactgtgtgtgtaagtttaggctaaccgcacgtctatacccagaacttaggcactggctgtttttgacttcaataactttcctgaaatgacaaagtaggcatgtattatatctttgcctaaagacaacttttatgagatcatacattcccattcttgggagggttctttcttttttctttttgctgaattaacatttgaaagaagaagtcatttggttttattaagcatgattcttctactttggtagactaagcagttcaaaatgtactaggaagatgatgaaagcaaccaaacaatttatctgaagagaaagataaaattactaagagcctgcagattaaagaacacattttctgttttagattgatatataaacacaacacttaaagaggaaacatgagccaaggacgcatcttcaatacagtccctcaaattttaactttaattaatcctccgaatttcataacaatgtattttctaatgacacggggactcacttcggaattctaagtaagactgttactgttcccaacgcatccttgtgttcctaatgactaagctttaaactattaatacatatcttaggttaattaagtgggctaattttccttgcctaataattgttcacgataatctaacactgtttaagctccaaaataaccatctttgaaaaatatacatccttaagtgtgtctcctcctattatcagtggggaaaatgtgacagtaaattactgagtaggaagtacagaattcccaaatacaaaggggcccagattttaaagtacttccaattttatggcacaataatctaatcttatcctcacaaagcctcctcatctcctggctccaagatcagaggaaattctttaagagagagggacgaggtagaagccgtgtgtacgtggttttgagaccttccctaagctaggcctattcctgctggcctctagttatgagaaagaacactgaggcctctcgcacatggctttgccaccaccagatggcacatcaccatgaaagcaggttacagacagaattctgccacagaaatcaatgtttcttggcaagcagtcatgaaacaatctgttcctagaaactctgcaaggtcccaggtcttggccacttagaaactcctcaagtcccttgcatgatcaggacacagaattcccaattaagaggcaggaagcaaaacaacagagagccctagatgaagggcaatactctaaaggagaacatgtagcagctgggccctccagattcctgcacccctgtccacagacaggcagaggggcctggacagggattaaccaacccacaatattccaacgatcatgcgcaccacccatttctttcaataaaacttatctgcaataatcctcatgctaattaacaattatctagtgcagacatttacagatggaggtcgttgaagacgggaagtggacatggaactgcgaattcttgttggctatctttaaaatgctaaccgtgcctaccattggaatgtgtatttctcttttggacactataaatgccaactaaccacccttaggacatagagtgaaactagcccacacatataaatattttacaccatctatactaaaatattttagaggaaaattatagacagacaacagtatgagcttaaggatggagtcggcactcaggatgtatgaccaccagaggagttcagagggacaggagtgactactgtcttcatttctccattccactctctcttatacagcccaagttttctgaaatagtataccaaggggaacttctttccctctcaatttgaacacaagacagcaaaatagctaaaggtggccgagtgtggtagctcatacctataatcccagcactttgggaagctgaggtgggcagatcacctgaggtcaggagttcaagaccagcctaaccaatatggtgaaaccccatctctactaaaaatacaaaaattagctgggtgtggtggcaggtgcctgtaatcccagctactcgggaggctgaggcagaagaattgcttgaacccgggaggtggaggttgcagtaagcccagatcgcgccactgcactccagcctgggcaacagagcaagactctgtctaaaaaaaaaaaaaaaatagctaaaggtgaaaatttcaaataagcagcctctcacaagaagacaaaaactagactctatgtaaatagatatgaaaacagtgccctctttaaagtgctttttttctccctgcttaatggtctagaaaagacacataattgccttataatcttacagaacctctatttgagcaacaaagttgagatgtcccaatggagtccagttggtgattacatcattagaaggtggttcccagcctgtggtccggtccccaaatgaatcaatcgatttggttgttcccagtttttttctattacaaataaagctgaatcatacaatatttggagtgaagataagtctccatttctctaagataaatgcccaaaagtgcattcgcttggtcatatggtaaggaaatgtttagtttcataagggcagtcatgcaagacagaagtaggcagaattcagagaggcagaattgtatactgggtacagatatgttctctctctgaaactaaatgtcttagttttatacacaagcttcacaacttaccacccatcagatcctcattgatcaaatggagattataatgataatgaggccatttcaacagcatcatggtgatgatttgattagttaattcatgacatgttcttagaaccacctctgacaaacactatcctttccacagatgttagctactaaaatttgcatgatttcagccaccagtaagatttaatattttaccctatattcattaacttactgaatttcttctcttatggattaaatgttcatgcttgaaaatacaagaaaagatttcattttgtttcagtatcaaatgcagcactgcattcaagaaagcttaaacacagaaacatcccgccagtggggcagagtacagtcgatttacacaagccagagttatatgtttcattatgtataggatatcactctatagtctaagatacacttgctcaaatggtttttttttttttttttttttagacggagtctggctctgtcgcccaggctggagtgcagtggcgtgatctcggctcactgcaagctccgcgtcccgggttcatgccattctcctgcctcagcctcccgagcagctgggactacaggcacctgccaccatgcccggctaatttttttttgtatttttagtagagacggggtttcaccgtgttaggcaggatggtctcgatctcctgacctcgtgatccgcccgcctcggcctcctgctcaaacggatttaatttgcgtggggaagaataatgctggttgcattcagccgcaacagagcagttgatcaggaacagaccctgtctgagaagcgtgtctctgtttgcactagtcgtcctcggaggacacaataccttggctcagattcgcagctgctttgctttgtacccttcactcactcagtaaataggtactagtgcctcccattagggccctgggttggaccctgagaagaccacagagaagggtaggcatctctccaggagctttgatcctgaacttgacttaaacaccagaacaaatggctgtgaaaggtggcaaacagctcaatacaaatgaatgtcacagtctagagatgatgtagcagcagaaaaaaggaattgctagagattgtaggggacaaagtaaagatgaaataagacttcttacagaaagcgactctggtgagactaagctaccagagaacctgtttgggctgagagaaaaccatcagcctagaaaagagggcatggccaaaagtttaggtatgcacaggggcgttcattcttctggaaaacaatgtggccagaggggacagtagaagccaggaaacaataagaaaaaaatattgaaagaattgtagtctgaatgtagaagctctagaatactgactgagtttacactttgctctgggtataataggggcctttgaaagctttgtaaaaggaagtgtacatcataagcagggtattttaggggataaatcttcctgcagtaagaagaatgaattggaaggggaaaagacagaaagtaaggcactctgtgggaaaataatttcaactgcgcaagcatgaagcgatgtggatccaggccggagacaggcaagaagactggaagtcagattgttctatttattttccggagaaaaagaaagcacacctatgctagaaaaatagcttcggcaaatgccccatataataaattgtccttcacttactccacccatgtgtttttgctttaactaaccatgaatagctgcttcagcaccagcctgtttatcatcctcccacgtccagcctagcaggactgaactgaaaggatctcagagtagtggactcgctggactgcaagatgctactcctgttaatcttccattactctttgatgttacgtctgtccctcagatatcacgggcaaagcatgccaagatattacagttgacacctggggtaagccagtcttttatcccctattatagctgtatagctcttaaacatagtgtgtcattgaataccatgctctactatttagccttactaaagacctgtgaggttataaaatctttattacaaatttcttattcataagtttataatttaacagtatgctattgaggcatacatgaactgagtgggtcaactaccacactgtggacatgttctagaatgttactgtgcttttggttcttcccagagggctgctgtctccccagatcctggaagcagaatccctgtagagcacataacacccccaaatttaacccagccatggctgtcatttggctggccagcaacccatgagataatttcttctaaaatttggctttcaatttctggtccagcatataaggagcttggaagtcaccactccaccttaacaacaagtcaaaagctaaacaaatggaaacatcaaaaattcttcttagatccatcatagaggtgaggtcacagggcaaacttctgccccacaaactggagagacaggcagatactaaaaatcacaacttactggagcagaaatccatgagcagaagcctctttggaaagtcacgctggggtaggaaaatctgaaccgtaattgacagttgctataaactcagcgtggacaggtctgaaagttaaaaactacagatcaatacagtgatcagtccccacctccccatacccctcaccacctttgaaaattttaatctcatggagcttaaccaggttctcacggtggctatcggagaaaaaatcactcgtgtcttcagcaggtagaagggaaaagtaaccattttgaaatatatcagataattcttttttaaaaaaaaatgtgtgagtatgtagtaagtgtatatatttctggtgtacatgagatgttttgatacaggcatgcaatgtgaaataagcacatcatgaataatgggtcatccgtcccctcaagcatttatcctttgagttacaaacaatccaagtacactcaggttattttaaaatgtacagttgagttactattgactatagccaccttgttctgctatcaaacagtaggtattattcatccatttttttgtacacattaaccatccccacctctataagtaagtgaaaaaacctacaagtaagtgagaacatgtgatgtttgtctttctgtgcctagcttatttcatttaacataataatctccagtttcatccatgttgtcctttattttttccaataggtttttggggaacaggtggtgcttggttacatggataagttttccgtggtgatttctgagattctggtgcagccatcacctaagcagtgtacactgtacccaatgtgtagtcttttatcccaaccctcacccaccctttcccccaagtccccaaagtccattgtatcatttttatacctttgtgttctcatagcttagctcctactgatgagtgagaacagatgatgtttggttttccatttccgagttacttcacttagaatactggtctagccacccaacagacctaccaggctctgggctggtactggagaatgtctgcaaggagtcctgtgatgtgatccatcttcaggtctctcagctgtggataccagcacctgctctggtggaggggagttaagtggactctgcaagggtcattggttatatttttgttaagtgtgctggttttgtgttgtttggcctccagccagactctccttgggtgaggcttgctgcagctgccatgacagatgggagtatggttcctaggccaacagagttgtgttcccaaggggattatggctgcctctgttgtgtcacacaagttgccagggaagtggaggaaagccaggaaccacaggcctcactcagttcctgtgcagcccagagctagagagaccagtctcactctcaccatgctccacaaacagcactgagtttacttccaggcagcaagtgagcaggcctgagaacctgccccaggctacaagcctcccagctgataaagcaagcagactcacagttcctcagctgtcccacagaacctgcaatggcaatccacctccttcaaagggtctgtggattcttttggcttttctggtacattcttgcagtagttcctggagcaaaagttcattatgtgggtctccacatcctgctctgtccatctgagtggtaactgcaagttagtcctgcctcctagccaccactttcccccagaaaatatccctgttgctctttttaacaagctctgactgcaagataaagtattttaccaaagcctgatcttctggggatgtatcagagcctaattgacctgatggaaggaaaatacccccaatcaagctagctctagccttacatataggagaaaggacacccaaatccagcccccgacatccatcctgtctcatctaaggcttgagacctacccataggactatgaaacactgtcctacatcttaccacccaccacacactaaaggcctatttacaagacttccttttgcccagtacatcacatccacatttcaccaaacatgacaaggcacactaaacggcaaaaaatacagtctgaagagacagagtaagcattgaaaacagacccagatatggcagggatgttgaaactattagaccatgaatttaaaaagactataattaacatgcttaaagccctaatagcaaaagtagatagcatgtaagaacagataaataatgtaagcagatatctagaaattccaagaaagaataaaaaagaacactagagaacaaaaacactgtaacagaaaggaaaaatgcctttgatggctcattagtagaccgaatacagctgaggagaaaaatcactgagcttgactacattaaaacagaaacttcaaaaactgaaaagcaaagagaaaaaagacagcaaaagaaacagaacataatatccaagaactgtggaacaactatgaaaggtgtacatgtaatggtaataacaaaaggagaagaaatagagaacacaaaagaaaaaagtatttgaaacaataatggcttagaatttcccccaaattaatgttagacatcaaaccacaaatcttgtaagctcagggaacaccagacaggaaaaataccaaaaaattcctgcacctaagcatgtcatatgtaaatggcagaaaatcaagacacagaaatatcttgaaagaagccagaggtgcaggaaaaaccttatgtatagagaagcaaatatgaaaagttacatccaatttctcttcagaagccatataggtaagaaaagggtaaaatgaaatatttaacatgttgggagaaaaagaaatgaacctagaactttgtactctgcgaaattattcttcaaaaaatgaaagagaaatcaacactttctcagacaaacaaacattgagggaatttgctaccagtagacatgcctcaaaagaaatgttaaaagttcttcagagagaaaaaactaaagatatgtcagaaactttcatctacattaagaaaggaagagtattaaaaaagaaataaaataaaagcatgtgaaatgtattcaggagcttatagaatttactgaacctggtcagttttccacaggatgagcagtgaattgtactgcatcttaacagtatgtattaggattcttgcagtggcatgcaggaagatatattttaccagatattattcttccaagatactgagccccaggggggaggaaacttgtggaagctggccaaacagattaagagaaaaaaactgctgtagtctccatatcatgaggaattgctgtagcctgctacatggtagtcctatgatcctaaattggcccagattcttgtctagattcaggcgttaggtcaagagctctccaaagtgctgcacttactgttccaccctctgctgaaagaccaggaatatagcacaggttgacagccaaaacagggatttaaagaatgtgagaaggcctggaagaaactaatgaagaacaatggggaggagttggagttccaaggtaccaaaccacagatttatcccccagacaggagagacttgtggaccccatcttggctgtttcttctttcttcgttttgtatttcagaaatgtatcctttagttttgatgatttggttcagactgagattgcaatgtgatttctgttctccaacataattctgtttctttatctcagttggagaatcaaatagcatattaatatgatacattacactagatttcacctagagtgggtaataaaatctattttccaaccttttcagtctgagctcaaataaagttaatctaatttaatatgtcatcaataaaagttggtctatgggccaacagttatttagggaagggggatggggagaagtttgaaggataatttagaggttggtttgatttaagacaagttcaagtttagcaatgcaattttgctgcatttactatacatctctatgatgaatgcaaggcagaaaaaccaacctttacaatttctatctataattaatgagtggcttctagcagggttggggtgaggagagaagaattgtgattataggagaccagctcaattgagtgatgtcaaatcttctagaggccaatgtaaaccactcagcattcccacttgtatattctggggttttgcattttttttaactcatgatagaatgaaacctgattagaaaggaggcaaagagactaatgataagatgatggtttaaattattgaagccaattaattacacacaataagtgccactaatagtggtagtgtgggattgctaagaaagtgtttacgggattgggagggagactcagccctaacatctccttctctgtctctccagagcaggatctctcccagaggtctctgctcacagacaaactccaccccagtggggcagtcatagtaagaaattccaagtataggagctttagtcctactaaagtattcagaattccatcctgcttcccactaggtgaagcctaagcactgaaggctgactctcagccctcttctctccttccttgctgcttcctggagagtggcctccaggagaatggacagggatttgcaatcccatccagggtgggaagcaggaagtgagaagcggtagtaaccatactgcatgtctcccattcctacaacacctcccttcctgaatccagctcagctagctggagatcatacttagtctcctggcaaagtgagcctgcttctataccccatcctctgacaggggcattgtttggaatgggcagactgcctggaactgcaaccctaccggacttggagcatcacctactttgctaattgccctacactgcctgtgagaatgaacaccgtttctccattgacccacatcctagggcaaaggtatgtcttccccattcctgatctttccctcaagtggacatcacacaatctgcttgacccagtattctaataaaagaatctaaacaaaacacagttattttgttagggatatactgttttcaacaccttggtcagtggttgtcaaccctgattatatgcacctaaaaatttaaaaagaaaaaaaaagccaacatcaggccctgtctcatgggaattatgaactaagtagtctgggtggagccaatgcgttggcatttttgctctgaagtgcagccaggggtaagaacaagtgagttaactagttagactccaaaccctctgatccccacatagctcccatgttgggagggccaccttccatgccccttcagtctgtgcctgctgggtctcttgcttctaaatgatgagtttatgtgccaatggtgcatgcacctgctccccaaagtgaggcaatgtgattgtgggaaggacaaaacacaaggaatgaagaaatgacaatgctccctattgaaatacctgatgagactactgaagcaatcagaatgagcaatttgaacacttcaggtcttgccttgtgccagaaaaactgcagtagaaaattcatagagcttgaaagaggtctcgtgaggtctttttgttcgtggccattttgcacagatgaagaggaacctaactttgccaacttccaaaggaagactccagaagaaatttcatctagtgactccggagtgtagctctgatgctacctagaaaatcttctactgaagtccctctgcagaggctgctgtgctagtttcctggggggcaagaaagagaggagctccaaagcccaatcacttcatagtaaatgacagcatacttttagtcagaagaaatcacattttgcttccatttctttatattaataaaatattgccatgttaaaaaaaacttcatcccgctacaatgaagcttttcaagatttttttcttagaaaatggcataagccaatataataccttataggtaacacctggaaacaattgaaaaagcaaagaaatgatagttgaacacaaaaattccagacccctaatgtattgatcccctattttccactagcgacattcatttcaccaagatttgccacaggatgagagaagaaaatgacaaagacacaggaaacgtaccatcaataaccaatatgctgtgtattttctgagagtcagtcatgtaactatctaatgaccaacaaattgtgcaccagtttcttgttcaaacagtgtaaatatgtgtgtatatacatatatatgtgtgtgtgtatatatatatatatatatgcatactatggtggaaataaaagtcataaatctttaaaaatgaatctattcttgctcaaaatttaaaaaaaaagaaaattcccgtgttggttttctggttttgatattacatgggagtcatatggaacgttaccataatacgaaattgagtgaaggctacaccaggtctccctgtacattttttttttggcaacttcctgtgggtttctaattattccaaaataaaaaaagtttaaaagacaaaatgtaagaaaagaaactctacccataaaagaaataaagtggggccttagaaggaaagaagactatgcaagaactgtacagaccatcagtagtaataatagaaatagtagttgcaattgtagcagcatcagtagcaacagtagcaggagtagtagtaacagacagtagtagtagcaatagtagcagtagtagtgggcagtaatagcagtagtagtaacaatagcggtagtaatagcagcagtagtaacagtagcaatagtactagttatagcagtagcataacagtagcggtagtagtaataatagcagtactgtaacagtagcagtggtggtactaatggacagtagcagtagttgatagaaaatatttatattctcaagccactggggcagagtgaagaaggagctatgctacgttggaagggaaatgaatatcttacttaaatttaaatctatgtaggatttatctctcattatatttactaaaaggaagcaagaagctttccaaaataattcagtcctaagctatacatttcttacctactttccctagcacgcaatcttcgatttgacagcatgtgaaaatctcaaagcatgtgaaaccgtacattattcattaaatctatagaatatgtttgttatcagatatgggatttacttaatttacaaatgagttccactacctggtattaactgccccacactatattaggcatgtgagatcttctattcagaaagctctagcctctctgggccttagctttctccttacaggccggcttgagaataactactctagcagactatacccaaacacaatttaaatttgcttccttttgaagcatctcccaccatcagtcacacagagagaggcaatggagctggaaatggaagcacccccaaggttctggagatgcttagaacacaaagtacctgccacatgtgccggatgctgctctagacatgaagggctcagcgaagggctcagcaaagggcacaatagccactgtctttctgtcctcaagaaggaaaatcagcactgaacaagacgatctcaggtagggttcaaaactacagagaaaataaacaaggaacgtgatagagaatggtggcttgcagaggccctgggtcagagatctctctgcaagaaaacatttgagcagagacccaagaaaccaccaggagcaagccacagggaagaatttcccagaacagggacatcaaaggccctgacgtgaaaatcagtctgagctttgtgataaacagaagtaggaaggactagagtagacagaggcagagaggaagggaggggccaggtcatcaagtctctgtgatgggtcagacatgggggtgtaaggaggaggcttcagtgagaaaagtttccagatttctgttttgaggcactagctggaagagataccacttactgggcttgaagaagagaagcctaggtccagtttagaacatgtcaagtatggaatgctgctaagacacccttcctgccccggatctctggcctgtgggccaggataacccagagtcccccttgcagggatcccccactgcagccactcccctctagagcctgggaagctgatgtggatgcctaaggtctcaggacccacgaacccctcatcagcctctgccttgcccttgtcccctgagcctgggcgaaccactaatccccatatgtgagtctcctgttcctctgtggtgtctgtatcaattcctatggcttctgccacaaactgccacaaacatagtggcttaaaccaacacaaatctgttataattctggagatcagaaatcccaaatgcaccaccctgagctaagatccagtgttccttctggagactctggagggaatcggttccttgccttttccagcttctagaggctgcccacgttctttgggccatggccccttgctccatcttcaaagcccagtcacacccctccaacctctgcttctttcatcctatttcctctgactctcttcctccctcatgtaagaatgcctgtgattaccatgttcccacgctgataatccagggtcatctccccatccagattgtcaatcccatctgcaaagtccctttttcccacatagggcaacatatccatagattcgaaagactaagacatgggcatctttgaaggggctattattctgtcaatgataataccctaaatcctcttcctcacactgcaggttatttctcattctctatcctgccacagggtttttactggaaaaaatcagacagaaccagttctggcaggaatggaaggtacgaaaagaagaaatacagaaagaaatcacacactgaaattaacaaccgaaaatactacacaaccacaaaattgtaaaaaaatgtatatttacaatccaatccaaagttttacaaacgtgttaaaaactttagaccagttaaattcaattgagtttaattgagtaaagaacaattcatgaatcagtcagctctggaaccagaatatgttcagagaggctgcagtgtggctgcatggtcaaagactgatggacagaaaacagaagtgggtacacaaactgccaactgtttacagcttggtgtttgccttatttgaacatggtttcaatagttggctgccttttgccaaaacttggtgactggccagaactaaatgattggcacaagagtaggttatggtctgtttccacatccagttaggttacagtctactatgtacagagagacctttaggctgaacctaaaatacgtaaggaaccagctttagactagacttaatttaacacatgtattagggtataggaccagtgtacacaattcaagattaagacatacataagattgctgatgtcaagttcataatcaatttatgcacagttaaatagattcagtgccttttgggattgaagagggaagagagacacacactgggtgttggcttccattcaatgaaacaccagaagctgggtaccaaagcagcaccactgtatactgtgcctccctgggatctgggcagggtccctgcacagaaagcacatctctgtggcagggatggaagtcattacttaggaataaaagtagcccaaggacctgcctggcctcccccagcccagcagaactgagatgtggtagcaggcacactctcctgggaactctcagataggtcatgactgttgtcccccacctgggagagccatgggtctctcctcctccaccttgtgagctcttggaccccatgggtaggaagcagctcctctgggaaaatggtagatggatattgcatcaaatacacggccagcagccaatgccatgtggcatgccgcccacctcggctccaaccctctctccccaaccaccacttctgctcttccatattcttcccaaccctcctgctcatagcaccctcacttttcacctccctccagcacaaaagattttgaaatgggaacttgccttctgctagggttatgatgaataacattttcaatcacaacacatttcaatcataaggaaaatagctttagaggatccccagggagtaggagtaggtgaagaaaaagcatattcatacaagttagattacctattttttttaaaacagaaagttgccaatgagaaaatgggactccttttgagccactaaaatgttaatgtctgcgcatacctaaagagctatggattcctaatctttcttcctcaaaacagtaacatgctttggggtttagagagcagattctaagtctgaagcccacacccatggggacagcaccacagcttaaccctaagtggtcctattggcagaaactaaattggaagattctggatgtctgcagcctagtaggatggcagggttcagtcactggaaaaccgtcacatatgtgtctttgagccttccccacaaggtgtgcagaactcttctagaaggacatagagctgaggttttatcaggctcaaggttatcttgcctgctttctgtagatagcaaattttgttcaagacttgctttcactacagactagtagcaaggtgtattagtcagggttctctagaggaacagaataggagatagagagaaagagagagagagagagagaagtttattaagtaatattaactcacaccatcacaaggtcccacaataggccatctacaagctgaggagcaaggaagccactccaggtcccaaggctgaagaacctggagtcctatgttggagggcaggaagcatccagcacaggacgaagatgtaggctgggaggctaagccagtctaagcttttcacgtttttctgcctgctttatattcactggcagttaattgatgcccacccagattcagggtgggtctgccttccccagcccactgactcaaatgttaatctcctttggcaacaccctcacaggcacacccagaatcaaaacttggcatccttcaatccaatcaagttgacgctcagtattaatcatcacacaaggtttgagggcataactaaccatcaaccacctcttactgttgaccagacaattaccaagcaaggaacacatcagagctgggtatcgggcaccaagttcagggcagtcctcagtggtgatatttagtgagtgtctactgtgtgccaggccaggggttactgaaatggatgacaggactgtctttctctttcaaggggctccctctcctgtagctcagtggttatgtggccttgccaggctgaccagaacaaacaccaatgctaccatttcctagaaagccagtgtgagcactgtctggacagcacacactattgaaggcccaggtgagggcccaaagaaggcattgcccacaggtggtgcccagacagacaatccctgatctcctggccctgggtgatcacacctggatgaaaggtctgggtgatcacacctggatgaaaggtctgggtgatcacacctggatgaaaggtctggggaatcacacctggatgaaagctctggggaatcacacctgggtgaaagctctagggaaagaccttttattttttgtttttgttttttgtttttgagatagagtcttgctccatcgcccaggctggaaggcagtggcatgatctcagctcactgcaacctccgcttcccaggttcaagcgattctcctgcctcagcctcccaagtatctgggactgcaggcacgtaccaccattcctggttaattttttgtatttttagtagagtcagggtttcaccgtgtcagccaggatggtctcgctctcctgacctcgtgatccgcccacctcagcctcccaaagtgctgagattacaggcataagccactgcacccggccaggaaagaccatttttacaggcagtgcacacccaccagtgctcaaaggccttgggtcctcaacgatgcattattataaacctccacggctcacaagtttttaatactgcacaagcttactagaggagattgccacaagttcacaagaggagaatagatatgtgtgtacagaggctaaatgggagcttacaagatgagaattcacacaagcttataggaaaatatacacacaggctcacatggagagatgcacgtggggccacataaagagatgcacacaggctcgcatggagagatgcacacaggctcacagggagagatgcatgaggctcacatggagagattacacaggctcacatggggagatgcatgaggctcacatggagagattacacgggctcacatggggagatgcatgaggctcacatggagagattacacaggctcacatggggagatgcatgaggctcacatggggagatgcatgaggctcacatggagagattaaacaggctcacatggggagatgcatgaggctcacatgaggagatgcatgaggctcacatggagagattacacaggctcacatggggagatgcatgaggctcacatgaggagatgcatgaggctcacatgaggagatgcatgaggctcacatggagagattacacaggctcacatgaggagatgcatgaggctcacatgaggagatgcatgaggctcacatggagagattacacaggctcacatgaggagatgcatgaggctcacatgaggagatgcatgaggctcacatggagagattacacaggctcacatggagagatgcatgaggtttacatggagattgtacattgacttacatggagacaggcacatgtgctcacacggagagatgctcacaactgttggagccctcagaggccatcttatccaattcagtttacagaaggaaaatggagccaggaagattaatgtcttactccagacaacctggccatttcaggacagtcccagaattggagattatggtcatctgacaagatgtgttgttttttaatctccattcatactaaaaaattactaaggcacaatttcacccagggatgcttccggctttgtgtacaagcaggacaaggagaactggactgaaatctgcggctctggggcagttccctcagggctgcctgttggctgacaaaggagcatcagatagtccttttataagataactctcttcagcagtctcacactggcccactccaggccaaggtactcctccctaagtatctactgcccggcttctctcaggatatcccggtcctgctcacatctccctggtgagaatgcctgtcctcacccccaaccacagtagggtccctctcaccctcagcccccatgcctcctttagttttccttttagtgtttatgctacatggtattttacgtttttgttttgttttgttttgttttgtttttttaggtagagtctcactctatcacccaggctggagtgtagtggtacaatttcagctcactgcaacatccgccccccaggttcaagtgattctcctgcctcagcctctccagtagctgagatagaggcacacaccaccatacgtggctaatttttaaaatatttttggtagagatggggtttcaccatgttggccagctggtctcgaactcctgacctcaagagctcagcccaccttggcctcccaaagtgctggggttggtattttactttttgtgctttatcttctttactatctagagtgttctctgggagagggtagaaagagaggcagtttgcttgctgctttactcttagtgcctagaacagaggatggcatgtaatagacactcaatcagcacagcatgaataaaataatgagttaaacacatttcatttctaaatgcaaatattgctctgttttgtttgcaaaaggctatcttgaaggacatatgttgttacatttaaaaaaaattctggcaagtttccagaaaacaatgatctcttatctttatagctcactatggttcctcgaaccgtaatcatagaataaatgaatgactactgaatgggtaaggaagaagaaacatgcattagtttctctgtgatctcgccaccagcgaattaggctttcaaatgtccatctgcctggctgggctcagtggctcatgcctgtaatcccaacacaggcgattactatgagatcaagatgggaggatcacttgagatcaggagttcaaaaccagcctggccaatatggtgaaaccccgtttctactaaaaatacaaataaagaaataaataaaattagccgagcatggtgggtggtgtgtgcctgtaatcctagctactccggaggctgaggcaggagaatcacttgagcctgggaagcagaggttgcagtgagctgagatggcgctactctactctaaccagtgcaacagagtgagactctgtctcaaaaaaaaaaaaaagtccatcttctctattgtgagataaggagggggaaaggggacatactctgcaaatgcctccacctgaggacgagctccagatgacaactgtgtggtgtcactgtgccatcggaaattttcatacagctctctagactccttccgagggcatatttgtaaattattcagaagtgatggaaaataacattacacatagtctttcattttcctgacaaactgtcttaaagcaaatgcaaatggtcatgatgctcttcgagatcactccatgcttggatgaataacctgggatatataaataatgtaggtaattccaaggagcctttaccttaagtaacagttacgctccgtagcaggtcctcagtaaatgttcactggactagaagcttcctcccagtggtgcccacatagacaataaattccctgagagggaagtcaccaccgcttcaccccgccccacccctcttccagagttatcatggtacagccaagagggacccctgacaagtacctcgtacaggtcgccactgactgaacggtttgaaatcagttatctgggcaggcaaggtgaaatatgtttaatgcaaaccattttggcaaattggccagtatgaccaccagaaactgatagctgtgagcagccagtaagcagtactatgtgatcatttgcatgagtttaaaattatgttgaaagagaaacaagaaagctagtccaaatatccaacatttataaaagcagaatctcaattatattatcattaaacctagatgtttggtttgtatctgagcttgctgtgtccttttgaacctcctttccccactgccctgcacgcctcgtgtgtgcacgtgcacacacacacacacagtccacactctaaaatgcctccactgacaacaacctctctaataatgcagcgtggagaagagagctagaaaactgttatcatgttattcctccagaactcaagtgacaggagaaaatattttccagccctcacatccttgagatgctaaaacctgatctgcagttactttggtgctgaatacgagtgcctgatggatacggcactgtagcaagaccgatgatgccactgtgcgaaaccataaattgtgcacttatttaagatgatttgaatgcagaacaaaaggtaccttggaaataaccatccagcaaacgaaactgcattcctgagtggctaggcctgaatttaatgaaatgatgtgaaacatgtgcctgtagtatctaaaagatttgaaatataggtccttgttctgttaggaatagtttgggtttgcattgctaattaagttcccagtgaagggtgtgtgtgtgtgtgtgtgtgtttgtgtgtgtgtacatgcgaacacaagtgcctgtacatctacttgtgtgtataagccaatagcaaatagctacacaaaacacgcaatgctagaaacagcattactatacaagagaacacccttaagtttcagcatccagcctgcaggatttgaatgcaagcactgaattaagaggttgctttagggatcaggatggtcatgactccctagtaatcacttccctttgccactaccagcctctgcatgcaaagatatctaacgcaggtccacagagaataatctgaaagctaggaggccacagggaccttcgggatgcaaacattaagacataaaaacaaactcagccaatgcgaaaagaaaaattaaattacctttaaaagtgttacgaagccagctaggaacactaaggaaatttatacgagcctttgctaactgtctttgctgctagaatcttaattccagaaggcactgatgtgcagtcccttcagattctcgaacacacacagggatgagggttccacacagggtcaacatgcagttcccacgtgaggtgggccaaaacttcagggaagacaaccgttaacaaaataagagaaatgacagcttaaatgtgaatttggagaacaccttttaaattgtttgcacagatgtgacattatttacatgacaattccatgctcctcagcacagagaaaataaaacgagttagacgacgttaaagcaaccattaattctattaatgagttaaggattgtttctagaacttttccgttgcttcatcatcttgatataattaaaaatatttgttatatctgcaatgttgtttcagcacctactgggaaaagcaagtcagaaagaaaaaaagtttgctagttttcctggaaaaagaatgtttactcttgtcaaaaatgttgaaggcctttgggttcatttatttaggctgatcccattagtcaaaatgttgaaaaatgttttaggactaaatatttttccactccatgaagagcgttgactacaatacttatttcagaaagcaacaaagaaataggcatgtatcaaccaaaaaaaaatcacttagcttctttaacttgatgttgctaccgtttcctcaaactcagctgaatcagctccgtttaagtggcaatgctttggaagcaaaaaatgataggtgacagtgtggcaagctccatttcgaaaacacaggaggaattctcttcccttctcactcacatttcatcacttacttgcaatttctgtaaagtactctccaaactgggaaagatgaggaggccgtgggaaagattctcattcaagaaattcgagactcaccctttaccctgtaaaatattccgtgttgttgatctgtaaatagaattatagctccaccaccaccaagccgtgatgcaaaagtgcctgggtgaactaaaattaaatgccaatgaaaaatgcctctctgcacatcagcatctatctgcttgggccttttttggcttcctcatttgtctttattttcatttagagccacgtggtgtactgcctttcgctcaaggcactctccctcacagtcgtgggtgactgcgtgttgtccttgccacccacagagctacatgggggaaagaaattacttattgattttcctttctatggaatggtgtctttggctggtttcttgagacagggcagtaatgcacagagccccagcagtggggatgcaggcagtgtgccacactgggctacaccaccagggtcaccctctctcaccagggtcacctgcacttagctctttcaacaaaataaacagcatacacttcaaaagttgaaagaatgaacaaaacaatggtatgttcccatctgagtagtggaaacagcatgatttgaattttcttttactcttgtattctaaaaaaggtttggttgggatggcatactatctggttggttaaggaagtatatttgacattttcaggttggtcctaaatttaaagtcagaaaaaaaaattaggaatgctgtgagttgtgaatcaagtcttcataattttgggccgattaccagagatgccatttttggattcctgaattgttactagagatagtggtctgggctgagagcagtggttcatgcctgtaatcctagcattttgggaggctgaggtaggaggatcgcttgaggccaagagttcaagaccagctggagcaacatagagagagaccccatctctagaaaaaacatttaaaaattagctgggtgtgttggtgcatacctatagtctcagaaggctggtgtaggaggattgccaggagttctaggctgcagtgagctctgattgcaccactgctctctctagcctggacagcagagtgagaccccatctctaaaaaaaaataataataatagtaaaggacagagatagtggtctgacttcctacaagtctgacttctagagagcaggctggctttctgagctgattactgcagataacaagttggttttctggactggttgctgcaggctgcggggcagttctatttttacgcatagtctgaccattgcccgtttgtatgtttatatatccagtgtctcactctttcctcaaagaaggtggacctggcattttgctgctgaagtccgaaggagaatgcagcatactgtccagcctaaaacacacaccccactagggggcaactggctttagcacccagagcttctccggtggtttgtgacaccccattctgggagccgtttctgagagccacacacagcatgagtgtgagtgccgttctgttcagctgtcagagatgctgattcctgtggatgccactgaaaatctcagcataaatggactgctttccccactccccatagaggagctctgtattcgcagactttaaccctgcaccaagaactctgcactggtcgcaaagtcttccagttctccaaggcttatatgcaaagacccaccccacccccatagtaccttctcccatgacgatcatggtaccaggcccaacaccaaggccacaggggcagggtctagaggtgtccccttctgatgtacagtcaccatcgggctgctaggcttcctgcagccagcaagtgctcactggtgtccagcttggcctcaacatcttccatgagtttcacttattgctaccaactcactgtttgaggctgcacaacaggagacccagctctggtgccaatcagcccccttattcctgtttaaagcctcttgggggaacaaccccagggtcaaagatttaagaaggaataagaaaagtgatgttggcttcttcccataaatgtaccaagagaactcagtggtgtttcctgatgcccagaagctgggtcagagcatgtggcctccatccactgcagacttggaggtcctgggcagatgttcaagagcctgtttccaaagagaatggtcctaatgagtgactgacccactgaacttcagagtattccacctcagaccaaggtggtccaggtagtggcccaggtagacctgcctctatagggatggaagctgtatatctgtgggagactaagtcagacatcagcttgcacccatttagcctcagaggccactgtgggtgcttcctgcctttgctcccctttgacctctgtcccagtgttcctgataagatttcacaagcccagcagctgagtcttgttcttcttatcatctgacaaaccctcttcttgcccctaaggctcagagcacactgaaggctgggagggtcggttggtgatacttactttgattttttagtttaagttctgggctacatgggcagaatgtgcaggtttgttacataggtatacatatgccatggtggtttgctgcacctatcagcttgtcatctaggttttaagacctgcatgcattaggtatttggataatgaatttttttaatgatgataacaaaagccagtttaaatctctttttcaaaaccataatttaattttattcaaaatggtttgctgtatataagaaatataataaaccttgaagaaaacaattttgaaaagtcatctttcttactactctaagcttctatattaagctctagctaccctttagagcttgctggagaagtaaacaagcatccaatgcaaattgggttatacttagttctagttaaagaagaaaaatagctaaaggggacattgagtcatgagttcttctaaaaacaaagaggtaaacacagaaaacttgtaattaggaaatatctagggactttatatgcatacaggcaaaatgcgatactgattagattaatttttttctactgagttttgctatgtagcaaaattcaacctgttgaagtggatgagcagctatgccctgagcaaccacatttacaccagccctggccagcctgaggcaccaacagactgaaatgcagatctgctatgagttctcattgggcttttgctataaaatattcatggtgaattacaaaggatcatttgaatcacaatctctagaaacatgttggaaaggagaaaggcatcaaattgcatcttaggcttttatctttttttacatgccactctaaagtaattacagattattcaggccaatgttaaactcaaatttttaaaaatcaacatttataataaaatgacctgctgatttcttaccctgctcaccatatggtgatttatatggtgcaatgagggcccactactgcctcctggtggtaatgtatcttaattgcaggaaccattttacaaaaaatagttatgctttgaaagatgaaacatgaagttacaaatactgtgacctaaaaaatacagacttgacatctgtggtaggagagatatgcccaaccatccattcttaccatttgagggaacctattgtgagctgagtgttgaattagggaacaaaatttctaccttgaaaattcagtttcatcaatagaaaaattcagattactcaagccaaatgatcaaatgtcactagaaaaggaaacacatagtataatcaggtggtgttaactcaatatacataattttttaacccagaaacacaataacatttttcagacagcttgacataaatgtggacgggacacctacttgatttctctaaaattggtttaaggaactgattgacccatccttcattaatcacccctgagtttttctccctaacaattttggtcatgcaaaatctccagaagtctttgtgccaagtgtctaacccaactctattttgtatacctcaaaatccaattcaaattcaactttcttcatatgatttttctttcccactcagaattaaagtgatttctccttctagcagttagattggcaaaaataaaaactatgatcctgtctacaatagttacctccacccctttatgtttatataatattacaccattgacatcctttgccccacctgtcatggtactttgctgagctatgtgtttgtttgcttactgtgtatttctgccactagaatggaagtctcatgatggcaggaaccttgcctgctctgatactttaaggagcataccaagctcctgaaatactgccgtgcacgtagatgctcactaaatattttctgaatgaactatcagtcagtgttagtgaaggtattatagtcaaactcttaaactttctggtgagaatgtaaaaattattcagaggacagtttgttaatacacatcaaatttcattataaaatataacaattaaatataagaaatgtttgtcaatagaatagaaattatatcaatagtaagctatacagccatcagaaatgatgatatccaactatatttacagacacaaaaaaaggtccttgacatatatttaaaattaaaaagcagagtttgcaatagcatgtgtgatggttaattttaatatgttaacttgactgggctacaaggtgcccagatatttgttcaaacataattgtgggtatttctgtaaggatgtttttgggtgtgattagcatttaaattggtagattgagtaaaagagattgcccaccctaatgtaggtgggtctcaaccagtcatccaagaacttgaacaaaaagactgcccctaccccaaataaagaagattcttccagactgactgcctttgaactgggacattgactttttcctgcctttgatcttgaactgaaacattggctcttccttgagcttgccagccttcagactaaaactatactgtcagccctattgactttcaggccttcagactcgagctggaactaaaccatcagctctcttgaatctctagcttgccaactcactctggagtgagtgagatattgaaacttgccaaactctattatcatgtgagcctattacttataataaatatctttctgtgcatacatatacctcctattggttccatttctctggagaaccctgactagaacagtgtatagtaggatctcattgtgctaaaatattagaactatgtagatctagtttctgtagtgtgcccagtttgttcatgcctccctgtattcatgcctttctatggttcctttcacaatgactctaggcttagtcatgcaacttccttttcaccagtgagacaatagcaaacatgacttaagcaatgacttgaaaagtgcttgcgtattggagttgcctttctgctgctcttgaaacctgagacagccttgtgaaccagaccaagcagcctcgtgcagcaagagaagccactgaagaaaggatttagctctcctacccatgctagtcaagacccatcaccagctcactgcccacacaggaccaagctcagctgaggttgaggggagctgccccctcccacttccctctcacattctgaacaggcgacaccacctctgggtgcatctgacccctcattctcactactgagcacccatggactgaaacatggtggcacattactgcaaatcatgggcaacttaacaccaccattcaacagctgcagtcacctgagactggcctggaccagaactgaccagctgaacccagcccaaattgcaaccttaataattgcagactatgctgaattttttttatcttgcccaaattcctatctaaggggtctggggagtcataccctacaaactataaattctcaccagatgggttttatttaaccctatatatcgtgacttactttccaaatccaatatggcatataacactatgtgacaaagaagaaagtcaacatattttatcccaaaacatgtttctttgccatattttaaaatggtcctgcaaagctgtcctttctgggtaaaaatgtacatttgtaaagaatctctattaacatagctagatctttttcttccaggcctcccaatcctcaggagattaagtaggagtctaacaccttttacaggaaacatttgtcatctattgtctctaagggcagccactgtaagacttcaaaagaacccaggtctccacaatcttttattttaacctgaaggttttctttctattgatcccaggtctttagacaaactcaaccaattgtcagtaggaaaatgtttaaatttacctatagcctggaagcccctcccactttgagttgtcctgcctttctgaaccaatgtgtttctcaaatgtaatttgattgatgtctcatgcctccctaaaatgtataaaaccaagttgcaccccaaccaccttgggcacttgttctcaggacctcctgagggctgtgtcacaggccatggtcactcatatttggctcagaataaatcttttcaaacattttacagagtttgagtctttttgttgacagaatcatttattaaatggttagcatttcaagccactaagctttgagatggtttgtaatgaagcaaagactaactgatatgttactatagaacaacaacaactaaaaaaaaaagcctagaaggctatatcctaaattgttaatagtggttacctctatgtagaaattacagatgacttctggttcattctttttagcatctctgcatactgtttataataagtgcatattatgtctgcaagcataaaaaacaattaaaatccatttcattttgaaaaataatttttaaattgatctctcccttcttagatttcctgcagtaattactgtttgcatgactaattcaccaattaaccatgaagtgttttgatatcaaaaactgatatttaaggctttcattgttatttgactatggcaatggaacatgcagtgatactttttaaaaatgctgtgtatcatccatagttattaagcctatgactggcatacagcatggagccaccaatgatattatttactttgatttgaaatcactgttttgtattaacaaataaggcagagtaaagagtagaatatctgcaagaagaggagaggtcctggcaatggcagtgtccaaaataaacctgagttacctgaaaactcaacaccaaagcatttagtgcccacttgcaactgcctatgccctgtggtaagagtggggattcctgtggccatgccacgattctctgctcaatgtccaatttcaagcttaattcagattgatttaaacatgcatatacatatctaccagagaattaaacaaaccatggaaatttagaatacaaattaaaatttcttctagagacctaatctggaaaaagaatagtatttgaaaactagtaaagcaaacaatgtagaaaaaatggcttaagcaaaaagggttcagatgtgaaagaaatcatccttaactaactttccagaatttaatttttaaagaatatggccaagaagtcaaaatttattcacctccatcgaagttgatgaagaaatgtaagaaagcaggtgttatgtagctttatttgatttttcaaaaagactccatgtaaagctttaagagagagaacaaaatagtagatgacaaaaactaagcaaatactagattaagaaactaaagtgagcctcccttgccttcaactttgagttagcaaggagagtcactggctccttcaaggagcactgccacgcatcataaagctaagtggctctgacaaggatctgaacaacagggctctaaaatctgctgacaacactaaaatgggagttgcaaagaagaatgaggagctgtgtgaccaggtttaaaggaatctcaatcatttaggtaattgggccagcagatggcaaatgcagtgcattctggaagactgtgaaataattagtctgaaagacagaagctaatctagtaataatgatcttccatttatgtagcattattttttacaaagcacctttcaccaagtggttcccatagtgccttctgtaatgatcatgcatggtatgttaatgtgttcacagtgatagaacaggcactcttggtggaacagtgtaatctgcacgactgtcgcccagaagagaaggtgatgcccgaaggagaggtgggaaactcccaaggtgattcgccaaatagaaataccttttggacactaaggttagagaactaaaccagcaggatgtttgcttgaatttgaatgatgactcatgaaggatcagaatgctatttccttggggtgagattaaaaaatatgtgtgtaccaggatttagaggtttatctctaaataaaggctgaaagaatttagctttatctttctaaaatgataaaagcaccacacatctttttttaaaaaaacaacaactactttcagttagccaagtgaaacttttcagttttgtaaataattcccaaggttaaacaggaaacatgctgagtagttcaagggagagtggagagaacattgtttcacaggctgcatttgcttccctccctcagaagcaaacctcttctctccccctctactccccttcttctagaacttagtcaaagcagagtttgtaggatcaatatggccaggggctgccatattgatcagagcagctctagagagtgaatcaggctgtggtgccctagaaagaaatatcagaaggtctgtttccaatgtcctgtgtgacctgaagctcttccttctctaaatcattattagccataaacgttcactgcagatgatcatttcttaatcagaaaaatacttctttactgcacttggctcttttccactcatgctaacagataccacatttccccatgtccctttctccctggcataaaacacacctttcctctacctgtgcggaacagcccatgcttcctcctctgccctgccccctcccacttccctctcacattctgaacaggcgacaccacctctgggtgcatccaacacctcattcgcactactgagcacccatggactgaaacgtggtggcacattactgcaaatcacaggcaacttaacaccaccattcaacagctgcaagcaagccattccaagcagaggaattctcacagtcacggtgcttcaataacgcattagagctttttgagtttcttgtctgtcttacagttgttgttatttttgtgttagctagcaaacaaagctacataaactgttatgaaaagtatgccctctaagacctgcctaattttatctaattccaggatcctaaaaatttttctgggtgtgaattttgttccattttcttccaggaaagtctaagagtgtgttacccaaatagtgctccaccaggagaaatccaaagctggtaagatgtgcctgaggatctggcaaaaatcagcatccatggtcttggggattgcaaatattctgcttgcagcctcttcgtagattcttttacagatggcaattttatattgctttacactgtaacaagaaggaaataaatggggctcttatacttctcctcttcactgatgccaggagaacatagcctctggttcccaccagcaggaccttctcactgttcttggcacaagaagatgccagcaagtaaaagttgctaagcattgcttttagattgaaaataagatgcacatggtaggtttcactgcatgacttaagcaaagtgccaggttctgttttcttttaaatattctcactagagggatgggagaggggagaaaaagtgtcagaataatctacaaatcaaaatgctttttaatggggatgtggaccacggctttcctttgctggtttcatgaaacctttgcacactcaggagaagaatgcatgttagctggtatgagcgctgctggcagtctccatggagtggggatggaggagtgcagattccttttaaaacattattgaaggttcttctcagccatccacaccacacattgatcttctgtcacagctctatgtctggagggctggtactctccattgatccacagagagcatttttagtgcatcaaagaaatacagaaggtgggactcagagggaaaatcaggaaccacacttttagtgctggacacagctcagcagtataaaagtcacataaaatattaagctgaacttgagatttttttttttaatgttgtgaaatctgttgacatatgagactcaatgggacacaaaaaacggaaaggattaatacctcttttaatggaaaaatctcccctgacggaacagaagcaagccctaggacctgataaactgaatcccacattcatctttctgcaaaggaccttaggttgtaaatcacaagtgtctaggctgaaaagttcaatcagtcaagatgcggtggtaatgggtcaaggtcatgcatcaatccaaagacagactggttagttttactccacagtcaaaggttatgccccatccggatgataaaatctgtgctcttctcaggagcaaggaggtggctggcctgatagagcctgtcacagcaagggacaaaactactataaagacagagcttcccacccaagccagcatgccagccacccatggaagtcctacctgtgccacaaggtcagactcagggtccctgtttcagtcagcttaggctgccataacagaatgccacagactgagtggcttaaacaacagaaatgtattttcccataattctggaggctgaaggtcccagatcaggatgccggcggggttgggttctggtaaatgccctcttcctggcttgcctttcctcagtgcaaatgcatggagagagggagaaagagatgactcttcctctttttttttttttttttttttttttgagacagaggctcactttgtcgccaggctggaatgctgtggcacgatctcagctcattgcaacctctgactccctggttcaagggattctcctgactcagcctcctgagtagctgagattacaggcacgtgccaccgcacccggctaatttttgtatttttggtagagatggagtttcattatttggccaggatggtctcgatctcctgacctcgtcgtgatccacccatctcagcctcccaaagtgctggaattacaagcatgagccaccgtgcccggccaactcttcctcttcttataaggctaccaatcctagtggactaggtcccactcttatgaatttgtttaaccttaattgcctccacaaagtccagtctccaaatacagtcacactaggggttaggccttcgatatatgaatctaggaaaacacagttcagtccatcacactcaccttccatacacagccttcttttacctccctaatcagacataatatgccctggggaaaaaaaaaaaaaagatgaaagaggatattttttctttgagggagacattttagacacttttacctaaacctttttctaaatactgaaagagttgaacatgtaaatcaataatgaaaagataacctgctcatatccaagtggacaactaactcacgaaggctatgggacaaaaagcaaggtcaaaagaagacaattcttatgaatttgcagatttaagcttccaaaatggtgaattgcacaatctctgacagaacagattctcagtgtctagtgaatggacaaatgaatacatgaatgatggatattttctgataatgagaagaaactaatataaattaaaatcaaagtcagaaatggcctcatcaatgcttattcaaggctaaagttgactaaaatgactacccctttaaaatcaggatttcaaattataaaactataacatttcaaacacagataattacatttcttatcaaatgcatgggttcttgtaaaataattcagtttaatatatacccaatttaattaaaatttataagtggttgtggactaaaccaagtgtatcttaattaaatcagaacatggctcacagatgttaaggtcaaccccagttttaataaagaagatgcaaatataatcattagggacttggctgagtaattgtggtcaggtggaaagtaagatgaaaggaaggccaggaagaccccttctactcaaggctaaaaagtaaaacgacctacggagtgcaagtgcagaaagatggggttgcctgctcagtgagccgctgaaatggaggtaggaaattcaggtatgaaaaaccaagtcaacaatcaattaataaacttacattagataaggaaggaggaggcactttctctgacagttcacacatcatggaaggttgcaatgggttctgctatcaccaaaacaatcagaaatggaaacaggacattcttagagccaacgctaaagcctgaaggattgcatgaataaggttgacacataaaatacaaagttttcagttaaatcagaatttcagataaacaacaatttttttttttgctaaaagtatgtcctatgcaacatgcatcctgtattgtcttttctaaatttggcacctacacgtgaacttaggcctgtagcaaaaggcttatcaaggagctttctgtaattccaatataaaccacaacatttattgaagaattatcattaagggctgaccgaagtcttaaaatagaaagtatatacctgaattacactgtaggctcattgccagctcttggaagggatgcggagagacgatctaaattttaacattcgggtcattcctatccacctgcctgggagtccttcttctgaatgtatctccctcagatcacagcatactctgaggaatgtgtcagtcacagggagctatgctggtcagaaaatcaatccagaaatgttgatttcaggtctcttccgtaaacagaactgtgctgttaatcaaaacccaacggcacctctgcacccctggagactctgtgggcagatgaagaaactgaggccctagacggtgaaatggcttttccaaggtttagctgggtctccctggcagagctaagactagcaccctgctattgtaaatcacctttccatgagtctttcagtaaggaataaaacttataagtgctattgaagctcagaaatatatatatataaattttatatattatatataattaataatatatgttaattatataattaataacatatgttgattatataattaataacacatgttgattgtataattaataatatatgttgattgtataattaataatatatattaattatgattaataataaatatatattaattatatgattaataataaatatatattaattatataattaatatataaatatatataatatatattaatttcttgctctttggatgtttaggaaaaaaatttagataggtgaagatatcactcatttaacagtgtctattcactgtcaacttcatgcccagcactgttgtggatgctgggaccactgacacaatgctgccctataaggagatttagcagatgctcaccacagccttccccacctcctgccaggcacaaccagactacatttcccaacctgccttgcagctatatggccatgtgactgagcactagccaagggaatgtgggtgggagtgatgtcagatattcccaggccaggtctattggaaaccttctgcattagtcagagctcccaagagaaaaagaaccaagaagagagatggagatggagatagagaaacatgaagagatccagagatagagattgggagatgtaaaaagattataaggtattgcctcacatgattatgaaggcagagaagtcttaccatctgctgtctgcgagctggacacccaggaaagccggtggtgtagtctgaaggctggagagccagagagctgacagtgtagattgcactctaagctgaagtcctgagaacaagaagcatgagagaaaaagaaggttgatgtcccagctcagacagttggttagaatgggatttcaaccttcctcaggctttgtgttctgttcaggccctcagtgaattgaatgatgtccacccacatgggagagagcaaactactttactcagtctatggattcaaatgctcatctcttccagacatcccctctcagacacaccagaaatcatgttcaaccagctacatggacaccccatggtccagtcaagcaaacacctaaaattaaccatcacaccctccatgtgaaaggaggcagaagatccagcagaaaagtcccaggcctcagaggaaggaggactcacaaaacgtgtccgtgaatcactacctggaaggctgggcactagacactcacatagagctgtcatatgaagagagaactaatcttctattgtgtgaagtggctgaggtgtaggagtcatttgttccaggagagagacaaccatgatacacttccctggtggaacttagagaaaagacaggttctgggcaaatacacaaacaaaaacagatatgattgcaacttgttgtgagtgttttgtagaaacaacatgagcacaatgataaagaaaagctgagatgcaagaggctgctctgataggtttggacatggctggtaatgagccaactacaataagaacggtgagagtaatagcagatgccactacagtgtcctgtttgtggaaggccctgggataaatatttcatgcactgtaacttatttactctcacaacaacctgtgaggtaggaattattatcatctccattttacagataaaagtaaggattcttgaagccacctatactatttcattctcatgctgctatgaagaaatacctgagactgggtaatttataaaggaaagaagtttaattgactcacagttcagcagggctagggaggcctcaggaaacttacaatcatggcagaagaggaagtaaacatgtccttcttcacatggcagcatgaaggagaagcaccgaggaaagagggaaaagcccctgataaaatcattggatctcatgagaacttattattacgagaacagcatggagggaactgcccccatgattcaattacttcccaccaggtccctcccatgacatgtggggattatgggaactacaattcaagatgacatttggatggggacacacccaagccatatcaccagcatatttttgattggtcaaagcctgtactatacaaactgttaagtctttattattattattatactttaagttctggaatacatgtgcagaatatgcaggtttgtgacataggtatatatgtgccatggtggttggctgcacccatcaacccatcatctacattaggtgtttctcctaatgctatccctcccctagtcccacaccctctgacaggccccaatgtgtgatgttcccctccctgtgttcatgtgttctcattgttcaactcccacttatgagtgagaaaatgcagtgtttgactttctgttcttgtgttagtttgctgagaatgatggtttccaacttcatccatgtccttgcaaaggacatgaactcatccttttttatggctgcctagtattccatgctatatatgtgccacattttcttaatgcagtctatcgttggtgggcatttgggttggttccaagtctgtgctattgtgaacagtgcagcaataaacatacgtgtgcatgtgtctttatagtagaatgatttataatcctttgggtatatacccagtaatgggattgctgggaaaaatggtatttctagttctagatccttgagaaattgccacactgtcttccacaatggttgaactaatttacactcccactaacagtgtaaaagcgttcctatttctccgcatcctctctagcatctgttgtttcctgactttgatcaccattctaactggcatgagatggtatctcattgtggttttgatttgcatttctctaatgacaagtgatgatgagcttttttcatatgtttgttggtcgcataaatgtcttcttttgagaaatgtctgttcatatagcccactttttgatggggttttttttttcttgtaaatctgtttaagttccttgtagattctggatattagccctttgtcagatgaatagatggcaaaaattttatcccactttgtaggttgcctgttcactcttatgatagtttcttttgctgtgcaaaagttctttaattagatcccaatttgttaattttttatttgttgccattccttttggtgttacagtcatgaagtctttgcccacgcctatgtcctgaatggtattgcctaagttttcttctagggtttttttatggttttaggtcttatggttaagtctttaatccatcttgagttaatttttgtataaggtgtaaggaaggggtccagtttcagtttcctgtatatggctagccaattttcccaatgcaatttattaaatagggaatcctttccccattgctttttttcaggtttgtcaaagatcagatggttgtagatgtgtggcatgatttctgaggcctctgctctgttccattggtctatgtatctgttttggtaccagtaccatgctgttttggttactgtagccttgtagtatagtttgaagtcaggtagcatgatgcctccagctttgttctttttgcttagaattgtattggcttatatgggctcttttggttccatatgaaatttaaagtagtttttctctaattctgtaaagaaagtcaatagtagcttgatggggatagtattgattctatatattactttgggtagtatggccattttcacaatattgattcttcctatccatgagcatggaacgttttttccatttttttttttttttgtcctctcttatttcattgagcagtggtttgtagttctccttgaagaggttcttcacatcctttgtaagttggattcctaggtgttctcttctccttgcagcaattgtgaatgggagttcactcatgatttggctttctgtttattattggtatataggaatgcttgtgatttctgcacattgactttgtatcctgagactttgctgaagttgctagtcagcttaaggagattttgggctgagacaatggggttttctaaatatacaatcatgtcatctgcaaacagagacaatttgacttcctctcttcttatcagaataccatttatttctttctcttgcctgactgccctggccagaacttctaatactatgttgaataggagggatgagagagggcattcttgtcttgtgccagttttcaaagggaatgcttccagcttttgtccatttagtatgatattgactgtgggtttgtcataaatagctcttattattttgagatacattccatcaatatctagtttactgtgagtttttagcatgaagggatgtggaattttatcaaaggccttttctgcatcagttgagatgatcacgtgttttttgtcactggttctgtttatgtgatggattacctttattgatttgtgtatgtggaaccagccttgcatcccagggatgaagctgacttgattgtggtgcataagctttttgatgtgcttctggattcagtttgccagtattttattgaggattttcacatcgatgttcatcagggatactgacctgaaattttcttttgttgttgtgtctctgccaggttttggtatcaggatgatgctggcctcataaaatgagttagggaggattccatctttttctattatttggaatagtttcagaaggaatggtaccagctcctcttcatatctctggtagaattcagctgtgaatccatctcgacctgggcttttattggttggtaggctattaattactgcctcaatttcagaacttgttattggtctattcagggattcaacttcttcctggtttagtcttaggagggtgtatgtttccagaaatgtatccatttcttctagattttctagtttatttgcatagaggtgtttatagtattctctgatagtagtttgtatttctgtggggtcactggtgatatcccctttatcattttgtattgtgtctatttgattcttctctcttttcttcttaggggcagctgttggtgcagcttcagcaggcttaaactttcctgtctgctggctctgatgacagcagcagatctcccagcacagcattcgagctctgctgagggacagactgcctcctcaagtgggtccctgactctcgtgcctcctgactgggagatacttcccagcaggactcaacagacacttcatacaggagagctctagctggcatctggcaggcccccgtatgatgaagcttccagaggaagaaacaggcagcaatctttgttgttctgcagcctccgctggtgatatccaggcaaacagagtctggagtggccctctagcaaactccagcaaacctccaacagaagggcctgattgttagaaggaaaactaacaaacagaaaggaatagcaccaacatcgccagcaactggacagagaatgagtttgatgaattgacagaagtaggctttagaaggtgggtaataacaagctactccgaactacaggagcatgttctaacccaatgcaaggaagcttagaaccttgaaaaaaggttagaggaattgctaactagaataaccagtttagaggagaccataaatgacctgatggagctgaaatacagcacgagaactttgtgaagcatacacaagtgtcaatagctgaatcagtcaagtggaagaaaggataacagagattgaagatcaacttaatgaaataaagcatgaagacaagattggagaaaaaaatcaatgaaaaggaacaaacaaagcctccaaaaaatatgggactatgtgaaaagaccaaacctgcatttgatgggtgtacctgaaagtgacaggaagaatggaaccaagttggaaaacagtcttcaggatattatccaggagaacttccccaacctagcaaggcaggccaaaactcaaattcaggaaatacagagatcaccacaaagatactcttcaagaagagcaaccccaagacacataatcgtcagattcaacaaggttgaaatgaaggaaaaaatattaagggcagccagagagaaaggtcaggttgggttgggggatgagtggtggggagtattttaggtagagcagtggttctcaattgagggtgattttaccatgcaggagacatttggcaatgtttggcaacatttttggttgccactacttgggatgagtgtatgctaccggcatctggttagtagaagccagggatgctgccacaaattctataatgcataggacagtgtccctcacaacaaataattatctagccccaaatgtcaatagtgttaaggtggagaaaccctaggggagagtaaaaagtatatgcaatgcccctctattaatcaattttgttttgctataaaggaatacctgagactaagtaatttataaagaaaagaggtttatggggctcttggttctgcagactgtacaagcatggcatctgcatctgcttggcttctggtgaaacgtcaggaagcttacaatcatagcagaggatgaaggtggagtaggcatgtcacatggcaagagagggagcaagaaagagaggaggtggtgccaggcccttttaaataaccgggtctcacatgaactaacagagcaagaacacactcattactatgagaaggtcaccaagctgtccatgaatgatctacccccatgaccaaaacatctcccactaggcccatctccaacactggaggtgatatttcaacgtgagatttggaggggacaaaatatccaaaccatatcagccacccctataatggcaaagccccagtgtggctggaactggtatacatcagatggagcatacatcagatggagtggcaccagatgatgttggcaaggtaggcagggttaagagcacacagaggagcccttgtaagatacagtaggagttgggattttacttcagatgtagggggaagcataatggaccactgatgactgctatagaaaatagaatggagaaggagtcaaaagataaaaaagctgctctgtggaccagtgagatatgaagagggttagaacaaaacgtgatggcagaggtaaagtggatagattggaacttcaacttggagctggaaatggcagaatgtgttgatggcttgcatgggatggcgggctggggaagagggaggaggaaaggatgatgctccaggctctggcttcaacaactgggtgagtggggttgtcatttactgcgagtgaaaagagggagaaaattgggaggaggtcatgacaattctgaaaggcctgtgagcaagcacacagatatgtcaagtggatagttgaatgtgcaggtcttgggttcacataaaacatatgggctgaagatttatgtgggaggcatgaggatataccagctctcccagggatagagaaaggtgacccaagatgagccctatggccctcaaatatttacagttagggagaacaggaggagccagcaatgggaaaaagcaaaggccagatctgaagacaatgtggattgtgattatctggaagagagaatgcctcccagaagaagagagtcatcatctaccccaaccatagcgagaagtgaaataaaacacaatatgaaggccattggtgaccttgaagggcacagtctaaaacaaaggtcagagtaaaagtcagattaccagggcctgagatagtaagcacagacaatatgtgcacagaattcttttgagaattgagaatttttttgctgtgaaatggagcaaaatgatagggtaattgctggaacctgaaggggtcaaggaagatttaagaggatgagaaaaaccactgcctgtttgtaagctatgaaaaatgatatagcagagaaaaactgatgatgcaggaggaaggggaaggaacaagaagcagttaaatccttgaaaagatggtaggagtggtggcttccagagaacacagacctggagagggagaaaggagaagtattgtacttccagtgcagatgggttcctaggtttgatgctgctaaatgaagatgtgtccatctaactcctcctatttgcacagctaactcacatttagctgatgacctggttgtgagaaggacagaaaggaatagggtgctgggaggtttgaggagaaaaattgaagcatgaaatagttatcccaaagaatgaagagcaaatattctgggagttgtgaagggaataggtttgatgggcaatgttggaaactcatgagaagtttgagaccatgagtttgaagtgaagagccagccaacttgcctgaagtcctacagcaacatttcatgtttcagacgcagacctagacaaagcaagtgctgcgggttctccagtacacactcaacccccttcaggatatggcactcactctcccactgaccagagcactgcctatgggaggctcatatctgagtccccactatgggaactgcccatgactgaagggagccgtttctccaggtcatggttgctcagggaaaagaaaaaaggccttcttacctccatgaagagatactcagggcgtgacaaggttcaggctgtacccgttagtgtgaagagagccacactttctcaaaggaagacaaaaggggcaagtcatccattttattagactaatttttagagcggttttgtgttcactgcaaaattgaacagaaagtacagagagttcccatatatccctggtacccctccacacacagcctctcccactatcaacatcaggcaccagagtggtacttttgttacaaaaataaacctacacttaacacatcattatcacccaaagtctacagtttacattaggattcactcttggtgttgtacattctatgggttttgtataatgacatctatccaccattagagtatcacatgcagtaatttgttactgcatatgatactctattactctattatgcagtttattactgcatatgatactctgtgacatccaccaattttcatgggttactatattcatttgctaggtcactcataataaattaccacaaactttgtggcttaaagcagcagaagtttattctctcacagacagaatccaaattcacagaggccatccaaaatcaaggtgttgggaaggtcattccccctcccaaagctctggggaagaatctgccctttgggtcttccagtgtctggcggccactggtgtcctctgtattctttggcttgaagacacaatctctgcctccatcttctcaccaccttctcctctgtggctgcttctccttggtgtgtctcttataagcatccacccagatataaagacccaccagatagcccagataaatcatgtcaagattcttatttgcacctgcaaagatcctttctttaaataaggtcacattcaccaggtttcaaggattaagacatggacatgacttattagaggtctctgttcatcccactgtagttactcagaggtggggcagagctggacagaaatatctctggccttctccacaaatggagagagatgaggatactagatgctgggcatgagtgagaacagaggccatgctgggctccattaataatgatgggtgaggtggggaaactggagtgcatgatgataaattaattaataggtacaatgtacattatttgggtgatggataccctaaaagccctgacttcaccactgtgcaatctatgcatgtagcaaaattgtacttgtatcccatatgtaccccatacccattttttaaataaatcaattttaaaaataaaaatgtattttaaaataatgatgatgaagccagtgaggagtgcagtggcggttcagaggggccttattttgatcaatacttgagaattaagatctgctccctcacgctcagcccctcaacgctgttctcagtgacttgtgttaaaccttattgccagagaataaatgaaccacaaccaaacccggagtagacccagctgttccagtaattttatgccagcaccagaaccacaaagctaagaggaagagaaaaggcttcttgctttcctgtgacattttattttttattatcatttattattattattattgagatggagtctcattctgtcacccaggctgaagtgcagtggcacaatctcgtctcactgcaacctctgcctcccgggtttaagcgattctcctgcctcagcctcccgagtagctgggattacaggcacctgccaccacacccagctaatatctttattagagatggggtttcaccatgttggccaggctggtcttgaacttctgacctcaagtgatccacctgcctcagcctccccaagtgctgagattacaggcgtgagccactgcacccagctcctgtgacatttgaactgtcagtgagaaggacctctgctctgctgtgaaaggttcaactattttaaagctacatgtcattttttattttttattcatacataatcaacattcatgttttcaggtatgtgtgatcatttaatatattcaagtaatttttaaagatcaaatcagtgtcattggtatatccatcacctcaaatatttgccttttccttatgctagaaacattccaattattctctgcttgttattttgaaatgtacaataaataaagaaacttgtctatgttgatatctactcccaatctggggacagacatgctcagggtatattttctttcactaataaaaggtggattaatttttctgtgaaaattcttctttaaagtttactgcttctaaaagcatggaattttatttctctggtgatcagtgatgttgagcttttttttgtatgtttgttggccgcatgtgtgccttcttttgagaagtgtctcacgccagtcagaatggtgattattataaagttaaaaagaaacagatgctggcaaggttgcagagaaataggaacacttttacactgttggtgggaatataaattagttcaaccattgtggaagacagtgtggcaattcctcaaagatttagaactggaaataccatttgacccagcaatcccattactgggtatatacccagagaaatataaatcattctattataaagatacatgcacatgtatgtttgttgcagtactattcacaatagcaaagacatggaatcagcccaaatgcccatcaacaagagattggataaagaaaatgtggtacatatacaccatggaatactacatagccataaaaaggagtgagatcatgtccttcgcagggacatggatgaagctggaagtcattatcctcagcaaactaatgcaggaacagaaaaccaaacattgcatgttctcacttataagtgggagctgaacaatgagaacacatggacacagggaggggaacaacacacattggggcctgtcaggggagtgtggtgtgagaggcgagggcatcaggaaaaatagctaatgtatgccaggcttaatatctaggtgatgggttgacaggtgcagcaatccaccatgccacatgtatagctatgtaacaaacctgcacatccggtacatgtaccctagaacttaaaacttaatttagtttaaaagcatggaagtacagtcggccaccaccacccacccagccaattttcaatcagattcatctccaaaccacctggggtctgttgctggaatgtggggtgcattataccagagagcagagccacagacagcactggctcccctagtcagccctcaaagccattgtcttaaagtctaattggaattgtttttagaaaagagaattttgcaattaaaaaaaagtcatgaatacaggtccagcagtcatgactaaaacatcaaaacagtcatgtagaaaacacagaaaagagcgtcttgttaggtctcctgaatagtgactgaggagagcctgagtgaaggaacctgagaggggagagaggcccacgggatcctgcaggtgatgtctggctctcccgagagcccacggtggacggtgctagctcactttgtcacatttttcactccgggaaaggggtggcaagcaggacccgttgtcacccggtgtcttgtccttgtttgttttgtggtttgggttttggttcaccaagagaattatgaaagggagagacaggaaaatatccttgatgtgcctgagcaaaattatagaaacaagagcaggggagggtgagggagttcagtagagctgaaagaggttgcagcagctggaaatccccgggctgcagggtagaaggaggtgggagggagacgctgcagaataccaggcccctcactggccctgcaggtcccctcgctccagcctcccaaccctgcaacctgggatgagtgtccacatctgacagccactgagaaggcgggcctggcaaggtggcccttgtatgtattaatacatggagtgggcacctctagaagtggctgtgatatgtgggaagggtcacgtggcagagatgaaggtgtactgaaagacagcacgggaggctggctctgcacattcctacccgaggatgaatgcaagggatctgccttccccagagccagcaccctccgtgctccaccttctgcttgggggaaggggtgcctgtaacatcctggaccattgaaaagggaagctaagcacacataacaactcagatgggaaaaagcaaatcacagggcttagatggacctcatcctacagtacaattaaatgacatccaaggatgagcagaaggacaagacacagcccttggcactgccttcatgtggggcccactccaatgctgacagtctgcaagggctctccagtgagcactttgctcccagagctctgggcagagctcactggactggactgattcctgtccttgccacccacagctcctcccaacccagtcctctgctccttggaccactgagccccctgtctgttcccattccctccaatccccctaccctgcaccttctactgaaatcactgaatctttatccagtgggatgacaaggcatctggctctattttcctccaaatccaatcttcatagcgtaaatgttatgaacacaggaacttctttagcttttgatagtcaaagacaagttattgaatctcaagcaccatttttgctttcaaaaagcccaattcttgcaagtcaatagtttggatctcaagactatggtcacttcataaactccaaaaactatccaagaaactcatgatgagacatgacttcattatctgtgctgttcactgttcatggctattatgggggaaggaggtggccattaccaccttcatggagacctaagatcaaggaaacgcgggtgtgagaagcatcaaagtgtttgtgtttgcaggtgtattaccctggctaataaatctaaatgttttcccaataaagcagttgggtaacaactacaaaatattttatatgcttacagaatgtccaagatgtgtgtaggtgtgaatgtgcgcatttgcctataacacagaggtatcaccttagactagtagatgactgggccacagggttctgacaaacttatgggttttttaattatccaagtgttcttccctgaccatgtgttgcaataattgttagaaatatataataaatatacattttaaaagagtaaacaacagaaataaaataaaatcattaggtgtttttgaatcgcatttttgtggcagcccaggaagctgacgctaactgactggccagcagatgtccagggtgaaagacaagctgggccattggccctctgtcctgtgtcatttccaaggctcaggccatggcctcacacagagagctcccagcactcccgcatctttctggctctctctaaagagctgattcctctgaaaattccccttcccagggcttttgtgccctcccttctccaagttccagttctagaagataagaggtttccagaatccagacactttgagaatcctgcagtgctgtcagaggcccaaaatgtcatcctctatccagctgtgaacagaagattctcgaacacctactcgccttgcccactctcccagaggagatgacgccccttccagactcagttgagtctggagcctggattcactctgcactccacccagtctaagaatctcctagtaaggtaggctggacagtggcccctcataaggtccatgtcctagtccgctagccctgtgaatacattctgccaataggacactgcggatgcaactcagcatcttgagatggggagaggatcctggattctccaggtgggttcaacttcatagcacaggtgtccttgtaagagagggctgaggaagaaacggtatcacagaagaggaaaaggtgaggtgaccttgaaagtgatggaaatgatgcacccagcagccttaaaagtgggaaagatgaggaacagatcctcgctgaagcctccacaaggagccggccccgtcggcaccttgattttaggttagcgagacgctgctcagagttctttaaactactatgtttgtggcaatttgttacagcagccagagagcaacccctccctcccatccacccctaccctgttctaattggatgatagctggagtctttcaggagcccttgtgttttataacccagtggccacagtgaccctaggcgaggccctggtccttcaggctgcatggtcagtatatgtgctgcaggcccggggtccacagagggcactaagtagggagcaagacattgtttgttttttatttcacttgcttcccaagcaggaatttcaatgctgaaatcctatcatcactatagagaagctgagtgtaagttctgttggcagcaaaaattagcaatcagtggctactccctactcagagggagcagacaagttcaaagtcagctgtgcagaaagaagtcacggatggctagggatgctgggcttagatgtggctggctccagttctggtcgtggctgtcctcgtgacccatccagtatcatgcaaggtaacctttaaatagtttgcatttccagcttttcaactgtgtgatcagaatcagttatgccttctctccagaggtgctgcaaaaccagttacgttaagtctgtgctaattttcacactgtttgtaactagccagtgactcaagtacagcctgataagtgggggttgcaaacaccctggagcgaggtgagtgagcaggaccattgttgcgtatttcctgaaacatgcatatttgacatgtagcttggcaatgcagccaaagacaggaaagcaagactgctggctcatatcatactgcccagcacactctgcttcagtgtcttcaaaatgtttagctaaaagaaaatttcttcaaggtgaagcatagatagaagcccaacatgaaaaactggtaaatgtggcgtcattcacatcgacatgaggagcagatcttgagggcggcccagggcccctgcaagccgccccaagcaacttcgtgaaaaacctagaagctcccaggggagctcagcttggcaaccactgttccaatccatcctcatggctgttacagtcagttggtcccatggactacagagtgttttaatgaaaactggacctttcacatgaaaaaaacagaggcccagaattatcgtctcactgggcaaatgtcagactagtaccagagcatgaattgtggagcagacgggaatgacgaaggtcctataaattgggcccctttttgacatcactgcatcacctgacctcagccctgtgctatttatatcaaaccacatggcctcttccagcttcccgcacaatttcttgctttcctcccgcattccagatttgcccctttggagttaaccccttcaggcctctccttgctgcttctttcataaccagcttcatacagtcatttgcctaaaaaatctgttactgctaaagttacctccctgtcaacgttccataattacagggcaatagaaaataaacactactatatcccaaaggcaacctcattcaatgaccaagaaaaggccagagaattaaagaaaaaaatctagaaaacaacacaatttataaaatgcctgggttgtacccatgaagagcttttaatatatgcagattcaacagtggggcttgaatcatttctgaggtgcattctgacacctggccacaggtcctgttgctgtccataccctgctggtcagaaccaccgagccctctgctcgttacatccccttgcctcccctccgctgccacccagttctagctgcatggatagtttgaatttggctcctgtgtggcagcagagggacactgcaggtgtggaaaagagatattcaaggagaactccagctgaggatgttggctggatgcagccagaagatagcaaaggctgaaataaacaaagaccagcaacagagagcaggcacaggctgtttactcattacttatagcatgggaggcagtagcagtcagtggtgtttggcagagactgaagggaggcagaggatcagggaagcttcacagtggcaaagtgggaggctgcaggtgtgccctgagtggaggctgctggctgggggaagctgcaggtggggttcactagaagccaggaatcccatgtgattggttaggggagcgaacgtggctttctctggcaggtcctgagtcggaagtaggggaaaaaattagagttgtcagtgatgaatcaagtcctggccacttggggctggttgctacaggtgctattgtttggctcatttggtggctagaggcagcaatctgacttcatgggctggctgctgtagatcagtggtccccaacctttctggcaccagggatcagttttgtgaaagacaatttttccacaagacctgggcaagagtggggggatggggtgggaggggatggtttcaggatgaaactgtttcacttcagataatcaggcatcagattctcgtaaggagagtacaacctaaatccgttgcatgtgcagttcacaatagggttcatgctcctgtgagaatctaataccaccgctgatctgacaggaggcggagcccaggcagtaatgctcactcacccaccactcacctcctgctgtacagcccaggtcctaacaggccacaggctgctgtgggtctgcggcccaggggttggggatccctgctgtagataatgagttggtttcctgggcaggtgatatggtttggctgtgtccccacccaaatttcattttgaattcccacgtgttgtgttgtgggagggacccattgggaggtaattgaatcatgggggcaggtctttcccatcctgttctcgtgatagtaagtctcacaagatctgatgtttttcaaaagaagagtttcccttcacaagttctctttgcctgccaccatccacttaagacgtgacttgattctccttgccttccaccgtgattgtgaggcctcctcagccatgtggaattgtaagtccaattaaacctctttcttttgtaaattgcccagtctcaggtatgttgttatcagcagtatgaatacagactaatacagcaggtctttacagattgcgggctagagttctgttttcacatctggtgtggccttatccattcatatattctgtctctccagcagtaaaccaagcagtttcagcctgttccagccacatcagcctgcagtggagcagtgatggcaggtgggggttggggggagggtagtgaattgaatggtagtcccccaaaaagatacattcatgtcctaatcctcagaaccagtgaatgtgatcttatttggaagaagggtcattatgatgtaattaagttaaggatctccggatgcagttatcctgattcatctggatgggcccttaatccaacaacagtgtccttaaaggagacagaagaggagaccaagagaggaggagaaggctacatgaagacgaaggcagagattggaataaggcagctatgagccaaggaacacctggagccaccagaagctggaggaggcaaggaaggattcttcctagacccttcagcaggcctggccctgctgatgccttgatttttgacttccaggctccagaactgtgagggcaacaaacgtctgctatgatctaccaagtgtgtgctatttgttatgcagccctaggaggctaatacagcagctcctccacacatgcacattatagctttgttcctccagtcttgccctgcctaagggggaagactgcggaaagaggatatttcctagacttggttcaaataaccaagatattcagaagaaaattgaaaaattcaaacactcagatattttagagtgactttatgttttataccatgaaaacagacatccagatttatttttattttctcctagatatttgcccttttggagatctagacttcctttggtatgtggtcaacagtcccttgaaggtgtatctgtggctatttacctaaatacacacatcagatagtgtcattcatatgttggtaattaataataaatatagtagaacttgtttatagaaccagggtaataggcatgatgggcaatacatattacctgaggaactgtaacctatttagcatacttaggatttgtccagttatccgcttaatacactcccccacactctggagtttctctttcccctcttatctcctgccctcttttatgcctacattctggtcacttctgaattaaccataatattttagaagcaaaaaaacgtgtctatagccaaataagtactgcattgctttccaaattgaaaccccaaattgttaaaactctggacttattaccacttttccccatgcaatatccatgtcatattaattgtttagaccctgattgactctaatagactcaaagaataataataatttattatttgaaaataaatttcaaataatagagtgtggacatgtaattaatatgcacaacaaatgctcttggaaattcacgcagaatattcccaactgcagtaccagctatcattgcagcgtgcccacagagggtcagcagcatcccaaaacacatgcccagtcacaaatgggcaaaatcacatccacatgtgtaaacacattggagaataagttggtatattcaagtgcaactgatgcatgggttcaacttctttgaccccagctttgtttcaagatgtcagtttctgccgctcagcaggaattccccagaaaagaacctgccgattggcatctacaaagcaggccccctctctgcactattttagatctttcttttctcatctttgcagatagagaacagcaggaagaataaatgattggattcaaatatgaaggaatgttctcttttagcagacctaatttcattatgtttcacagagatggactgatgaagtcaacacatttacaccgaaaatctctacgtctcaaatgcaaatgtcaacgtatgtcacaaacctttataatttgcattccttagaactacacttctagaaatcaatcctagggaaataccagaaaagtgcaaaaagacatatatcaagggtattaatcacagtagtgtttatacagcaggaagaaaaaaaaatctggaagcattctaaagtgaggcaggataggtcatcaaggaaggttcttggatgcagcaaccatggtgacccaagagtcaacacaatcacattgtaattgagctcgatcaggcaaagctatcttcagtacagactttctcctctagagagcatgtgcgctttgattttacctgtcctcaaattgacctttcgctcattataatagtaaattataaatctccctgggtggagatttaaggtgctaatgagacatgcgatgtatgaacaagaattgcagctactgagcatgtgcacccacaggaccacccagaacatgtttatagcaacacctcttcccacctacttatgaataattgtgtaagactcccctaaagggagtctccctagagcaagtctttgctgtctcgtccttatgagcagcctgccctgattctcttacggtgtactgtctattctgcacctaactttcaaaatactctttttcttttgcaataaattactgtatgctacatctcctttgctgtgcatctcttaaattcttttaaactaagaagacaagaaccaaggtatcacaacagtgctcaaccaaggaaatcagtagataaattatgggatagctccatagtggaaaacgattagagtcattaacatgaggctaaaagaatgtatttatgggcctggaaaatgtttattacttattttaagtaggaatttgtttcagtttcctatggctgctataataaattaccacaaatttagtggattttaaaaacccacaaatgtattattttgcagttctggaggtcaaaatttaaacgagtctctctcggctaaaatcaagatgtcagcaggatggtattccttctggaggctctcagggataatactttctccttgccttctcagcttctggaggctgcctgcaggccttgacccatggttgctttctccgtcttcaaagccaggagagcagcatcttccactctgtctctgactctgccctctgcttccactggcacatctgcttcttgactctgacctttctgtctaccgcttataaggaccctgtgattacacgggggccacatagataatctaggctaccctccccatctcaagccccttaatcacatctgcaaagttgctttagtcatttaaggtaacatagtcacaaattccagggattaacatatggacatctttggaggtctatgatcctgagtgccacaaaagttcaaattgcagaataatatacctaggtatggttctatttttctatgttttgacaaaaattatataaatattggccaacagacactcctatcactcaggacatgccaaggttttgaagacctgtgccaggaagtgaggacgaagactggatatattccttgttctactacattcagcttttaaaattcgcaaaccaggaggagacctgccctgcttttctcagctctttgctcttagcagccctttccttcagtaatgattgcaaaatgcacagatgtaccaaaagggaggaggggataatggaggaggagagacatatttggctaatatttactcacattatcttccactcatgcgtgcatgcatatatatatatatgccataaaccttgaagctcatatgagacctctccctggcacagtgactccatgctcatattttcacttatttttctattcaacaaataagtagtgagtccctacaatatagtgaactccaggaaaagctctggaatacagaaggcacagggcttgccccactgggagcttacaatttagcaggtgagagggacaccaaacagctagggaaacagataattactttatcacaatggtgctgtgagggaaaagtactgggtggtgtgagcacatgctgggagagtaacacttgacaacaggatcagaaaaggcagtcccaggcagctccagtcactgttgaggactgaagcaagcgtaggtgtcagcaagataaagctgggaaggtagagtggaaagaagagggtcccagcattagaaacatgcatgcgagctctggattgggaagcctttcttcaaggaaccaaataaggcatagcatggagcacagaggatgagagagaaggaggatgcagctgcaggggtaacctggggccaggaatcggggtccagtgggtgaaagtaaaggtattgggcttatgtaaaaagcaatggtgagccactgaggggtttaagcagagggtcaacatgatgaaatgtatgttttaaaaacctgactgcactgcagtgtcaacaataaacaggagggagctaaggaaatttggggaggaaacatcgattgctatttccacgatatgattctggatctgacccagatgatggtatgggggcggagagaagtggacaggtatttacgaagatgaactctgcctcagggacgatgcccaagtgtccagcttgagcaacctgatgttgctttgaaccaataaggagtggtgaaggatctaattagaggacaagggaagggaagtatgagggtacggcatgagtttagtttcacttatgtagtcccaattttgtctcctgtctttataaactctcaacatctctcagaaaatctgctattttggtaccaaaccacatttccaggcttctttcagtataaaagtattcccaaggttcttttttcttttttaatcagaccaagagcctttgggtacaaaaatacagccataaaatctgtgagatatccccttaggcttaagaagtgacgttaattaaccaagcttctacagcttatatctattgtaaattttagcacaatgattataataaacacaagtaagcttgttttcttttaggcaaaaaaacatttggaaacctcaacctggaaacgtaattctattctggcaaagaccagatccctctgaaatgattactaccattactacccgactctcttttctgtactcaaccttgattaaataatgggaaacacatggataaaatgagtcccctgcaaatgtcaggacaaaagaacttttacccctaggttcctccagcaatatggcaggtttccctactacacagtgattaattcagagatatggagttaatctacaacaaagttccaacagacacattttaatattgtttattgtaaccagaaatggatggcacatactgcaacggttactaaccaattttcataatcaaaaagaattatgctatattggccaaaatattagtcatgggattagaacccatcctcccttgaatagcctaatcctctttaaaatagctcagagtaatcaggttagcttcacagtaaattttagtaaacccatcacttttatgaaataatttcagaaaaggaaagatcaaagttttttaaatccttgatgctgatgaaacactgggcaaaataaatgtcttacaaagcacttatataattgatttaagctaactatcctaatagagatacatttgccattacaaatggatttgtattataaagtggaaactagcactagcactgtggaaacaagttctcagtgctggttttctgaaaaatgggacagtaacaagaaaaggcatagggaaatgtctcaccaagcaccctgccttccagccatttttaaatgaaagccctttctggcaatgctattttgtgtaaatgatgaccagatagggtggctgattgctttgtgacctctgtttaacacagcaccctctcctagtcaacactatgttggcacgcaaaaacagcccgagcttttcaaagcatccagtttgctctgggggagcagtcaccttaagacttctaagaattttatgcatgcgatattacttggccacaaccctatcttcctagactgcaaaagtgcttgagaaaacaagaatgggatcacaagtgtgctcctgtaagtttccacagagattcagttcctaattggatcttttcatgtcatcttggattcttattttattctaatttatccactgtcaatccagacctatcaaaaaaatcacaatgatcacatctatatatctttattcaagttactgataaaaacattaaaggttacagaccctagaacaatgacctttgacctattccaagtcagcatagaatggcctcatcacccaacttgttgttcttcccaataagtgtccttgcatccaaccctaagttttctaaaggcttatccgaaactgaatatacacaaaatcaacaatgtgggtctcatgaatgcatgccctcaaacaggttctgagattcaaaaccttccattgactaatgaagaaaatttcccctggttccaccccacctaaacatgggttcccattactgtctcttctttgccatctgcccacaagtcagccaccctgttgaaagtgaaaaagctactgccaacataatttcaatcaaaatgcttttatacttttggagagtattagtgtgatggttaattttatgtggaaacttgactgggccatggtgactacatattgttcaaacgttattctggatatttctgggaacatggtttttcaatgagatttacacttaaattgagactttgagtaaaacagaatgttctccatagtgtggctgtcttatccacattatggatgagattagatgacattgtgcctcatccaatcatttgaaggtctgaacagaacgaaagactgacttcccccaagcaagagttgtacatgcatatcctatgggctctgttcatctggacaagcctcactaatacaaaaatatataatactttttattacaaaaagtgcaagaatttcctaatacattgcacaaaaacaatcttgtacccatatttcttcaattagtcattttatcataatagcctctttattctctttaagtggttcacacccagagttctttagaactctttcaggatgcttccaccttcttgtttgtctttgaagtcttaagtaaaggaaatataaatatttcaccactgcaattcctgttttctactcttcagaagatctcccctgaatcatgggtcaaaatacagccactctttggtatagaagtcataagaatattaataactcatagtggacttatcagtcatgcttattaataaaaacattacattcaggacacaagagcccctttgaggcaaatgagaaagggaagcctagctgagactgacaggaactggagtggctaagggaaagaggaccctgtgcacaaacacttctatggaacatgaagaaaggcctcatcggttctaggcactgccagagacatccacttttttgtggctataataatgatattttcaatgacaaatgatttctcaggagaggtcttggtctaatgagatgctaccataaagtaataaaaccacaaaagactgtaaaaaaacagaatgatagataagctatggaacactgccaagttgtctttgcatttcaattacttgtggcaataagagacagacataatatgggtaataaaaagccaaccataatccaaaaacttaattttagcaaatggttcaaagtcttcccacaagatcctttactaaagcaattgacaaatgttgcatttgcaggagagagctacagaagcctgcctgagaagaccacttaaaagccagagtctcccagaggagcagtgctgggtgaagtatccagaggtctcaaagagactggctccatccgtcctcaacagacagatgtataaataagaatgctggttctaaatctcaacaaaagaattcttgactcagcaggacacttacttcttctgatcagcacattctctcccttttgaaaactccaacattgacaattataaacaaaaggttgtttgatgagcatgaagtgaggacaagggaagcttgtagaataatttgaaggatagtgataccaactcttggggaaacaaacctttcagagagaccaaaacctgtgcctactgctagacatcctctccatgagcagtgaagttcctacaccagaaatattctgctcgcaaaagtcttgatctctgagccccttgtttataatctgatctcttaacaacaaggtcttttctcagatgaggtggtttagaatagactaagtacaactttagacatgctaatacaccataatttcctgaaagccactgactctccttcctaatcactgacaacatgactatactctaaaactcccctaatacccatttatagatcaatgcatagggtgagtgttctgggctgaattgtgtctcccaaaatgcatatgttgaagtcctctcccctcagttcctcagtgtacgactgtatttgaagacagggtctttaacgaggtgattaagttaaaatgagatcattttaagtgaggtcctcatccattacaaatggtggccttataaaagggaaattcagacacagagacaggtacaaatagaaggaagaccatgagaaagcacggggaggagatggccatggacaagccacggacagaggcctagaacagagtcttccttcacagcctcagaaggaaccaaccctgctgacacctctgttactggtggaagagatctgagttaccctgagttactggtagtgaatctataaggatccacagcaacttcagtccttgcctcctcagaagaaagaattcatctgaggggcataaagcagaaaaagagaccgaggcaagtttcagagcaggagtgctagtttatttaaaaggctttaaaacaggaaagaaaggaaaattcatttgaaagagacccaagcgggcacctgaagatccaagagagaaaagagagcaaaagaagactgcaaaaagagagcctttcaccttgatcccaggactttttgggctcacctcttcccatgattcttccctttagggtgggctttccacatgcccagtgcttgcaccctttggcattgagcacagcgcagtgtgtttaaggagttatatgcatgcccacgtgagcctttcttcccttttctggtggagttgcccccagaagatcatacttcaccacttttgtctcttgacacgtatgtccaggaagttgcttctccctggggtttgcattcaattgacattttgatgttaatgggtgtggaccattagtaagtggcctctccctcgtgctgccaaactgtcatttttagaaaggcaatgcaataaccaccgaaccatcaccagacattctagtgggtggaggaagagccctctcctgccctgctcatgcctaactacctgtaactcctccatatcagacttccagcctccagaactgagagacaatgcatttctgttggttaactcacccaatctgtgttacttcgttaggacaaccctagaaagctaatacagtgggtggcttcagaacttatgtgtggattttttcctctcagagtttttcataattttaagaggtttgcattagtttgtttgtccctacctaccaccaccaccaaacaataaaagttactacccacagcatagctaacgagcagggagctccctattgccaaagatggagggagggaagctctctctgttaaaggagggagcagggatgcttgtagaccccaaattacataattagctcagagtaactggtaaaacataggttgataaagaatcatgcgtatatattcattcacactattgaatatccatgaaaccattgtcttcacttggaccctcaatattcacctacccctttattcccaatcccctgcaatctcttctttttctctttttttagtgataaatgctacatatttatgggagaaggctagagtattgtggtggtgatgggtgataacactttttttcattattatactttaagttctgggatacatgtgcacaacatgcagctttgttacataggtatacacgtgccctggtggtttgctgcacccatcaacccatcatctacattaggtatttctcctaatgctatccctcccctagtcccacaccccctgacaggccccgatgtgtgatgtccccctccctgtgttcatgtgttctcattgttcagctcccacttatgagtgagaacatgcagtgtttgattttctgttcttgtgttagtttgctgagaacgatggtttccaacttcatccatgtccctgcaaaggacatgaactcatccttttttatggctgcatagtattccatgctatatatgtgccacattttcttaatccagtctattgttggtgggcatttgggttggttgctattgtgaacagtgcagcaataaacatacgtgagcatgtatctttatagtagaatgatttataatcctttgggtgtatacccagtaatgggattgctgggaaaaatggtatttctagttctagatccttgagaaattgccacactgtcttccacaatggttgaactaatttacactcccaccaacagtgtaaaagtgttcctatttctctgcatcctctccagcatctgttgtttcctgactttttaatgatcgccattctaactggtgtgagatggtatctcattacggttttgatttgcctttctctaatgaccagtgatgatgagctttttttcatatgtttgttggctgcataaatgtcttcttttgagaagtgtctattcatattctttgccactttttgatagggttttttttttcttgtaaatttgtttgagttcattgtagattctggatattagccctttgtcagatgagtagattgcaaaaattttatcccactatgtaggctgcctgttcactcttgtgatagtttcttttgctgtgcagaagctctttagtttaattagatcccatctgtcaattttggcttttgttgccattgcttttggtgttttagtcatgaagtatttgcccatgcctatgtcctgaatggtattgcctaggttttcttctaaggtttttatggttttaggtcttatgtttaagtctttaatccatcttgagttaatttttgtacaaggtgtaagggaaagatccagtttcagctttctgcatatggctagccagttttcccaacaccatttattaaatacggaatcctttccccattgcttgtttttgtcaggtttgtcaaagttcaagggatgctttttatggctctttaactgccaaatccagtggatgattttttgctatctttctggacctcttctacatgggatcccttcctccctgttgaaatgcgccatctttattcattcacatcacaatgaatcaagtctcttccatgatctctgccaatgatattattcctccaggtgccctggtaaatatcactgtctcttgaatttgtgctagcccacttctatcaatacataaatgtatttgccacttacacactgatggccctcataccaacatcaagaacctgaaaccgactttgcaaaaattataaccatgagaaaaattatggcagtgggggagatctgatctagctaaccctcatcttgcctttagccttcaagatgcccttaataattccaaggcttaaaccaaactaacctggggggacttttagtttatagtttaaatgataatagcccttccccaaaacttaaccacctgtgtaaagttaatgagagaccactgggctaggaggatacaggggcctgaattctgccaaggcatagatataaatgattgctagccattattccagaggtcacaagataggcaacttccccaattactcttgcatataacgtcactattgtagaacttaaggttggccttttgagatatcttttcaggttttttgcatgtctgatgaccaatggctccacctagacatgccaattgctcctttggccccacccagaagcaactcagggcacaggaggaccattggccacacccctatgattgtaccccaaccaatcagtagcaagcacccatcatgtaggcactccaaccccttcctcaaaggggacctttttaaaaccctagtccacaaattctcaatgagattaagtaacaactctgtctcccatttggcatggttggcctcgcatcaatgaaactctttctttaccacaatgtcatggtctcatgtgttattagtccattttcacaccactgtaaagaactgcctgagactgggtcatttataaaggaaagaggtttaattgactcacagttgtgcatggctgtggagacctcacaaaacttacaattatggtggaaggcacaggggaagtaggcaccttctttataaggtgtcaggagagagaagagagtgagcaagagcagggaaaactggcttataaaatcatcagctttcatgagaactcactcactatcacaagaacagcatgagggacgatgcccccataatccaattacctcctttcctccctcaacacatggggattacaattcgagatgagatttgggtggaggcagagaactaaatcatatcactgtgaattgatcttgtttgtgcagtaggcaggaagaacacaatgggtggttacaaacccagccatttcccattgcacccagcctagtacagcttgtccagctttctaataaggaaactcgatgccaattccactcatatttctttagaaccatgtccacggctcttcctggaacccctcctcagtggcatcctcatgctctggaagaggacacacatattttattggccctctctgctttccctgcttataagtatctgaggatttgccctgcctgtagaataggtggaaaacattttaacatgccatgccagaccctccacaaattggttcagtttatctttcagcctccactccattctctctccaatcttccaagctattcacagcagacaacttgtttcttctcagacatttccaggcctttgttcatattcttcatgtctggagaatctttctctcctaatctgacctaaaaagagctacttgtcttcctaagattgaaaaagcactccttctctttagctttcaatgaatcatactcaggcagaattctaccatattccatgttccctctgtatgttacaaacgccactattgcagtgtttatatactgtgtcatggtcatttgcttatgaatctgccttctccatcactgcatgagccactgcaggaagtggccactgctctctcaactccaaagtctcttaagccccctaccatcatcaacatggtgactcagtgctcctgaagggaattcagctcttcagaggagggagtatgcacggcccacataagactaagagaaagaaatggctttgcaaagaaataaaaaatgatattcaccagagaatcagcacaccacttacccttttcaggatttatgactttctgaatataaaaacgtctaggatatatcatggagaatggcaccatccaaggctgggacctggtctctgaaattcctgacaggcagttctgctaactacaacttcaaatgaccccttcttcaatttagctatgtggaagtaaaaactgacctttcatctgcctgacaaggttgatgtcaagatcaacacaccttgtgaaatttagctcttgatattagtgtgagaagtcgccctaagacttctggagcagcagaatggtctcaaaaaggggagtcttggggatggctcatttgtttgagggagtctctgaacacatccttttggttcctatgatgtaaactaatgcctgcccattgttctagcggaaaactatgagactccctgatgcaaattcaggttatatgattagtctgaactgtgtctttgtcgactctttataggagggtgtggaagaggaggagcagaaataaatgactcctgatttagtgcaattttagaaagaactattgcctattgaagataaatgtcagtgtttcacagtaactcactagatcccccaacttgagacctggaatatcaagaaagatgccaagacatggatcaccctctaacgctggagtttgggctacagaaggaaataagcttggcctgggaaaacaaaaactgcactgggtggttcacatgtgcgctggtgtgatgggtgtggactagtcctggcccttagagcacatcctgatgttgaactagcctcttctgatgtggtcaccctgagagcccctggggtgagaggtgagcactttcccctgaaatgagtgtgtctttatgaaatccatacccctgggaagagggagataggggaacatggaatgcagactccagaggtaaaccctgaaattggacagtggggagccactgtcttctctctgatcttgtaagcggttggatttcaaatggtgagggattactgccagatctcataactgacctcacaacagttgaaaactattctcggaattgtacttcccttttgtcatccatagacctttggtagaaattttaccaatgctgagcctgactttagtcatgcaatgcgctctcagtggaaagccctgtgtgatttcggggatagagcggcaaagggggtcagtaatgttcctcccacgtggcccaagtagtggcccttcagccttccccaaaagagagagactggatccaccatagacgatgccacatgagggaagcagggaatgtggggggtgccaggaggatgatgctggatccaaagatgtgagggagtgaagcacacagagctcaaatccccagaaatccctcaaatacccaaggatccactggaggggaacaggcacctgcagggggacatttgaagtcatgtcactttgcaaattcaagaaaatataatttctatttgtacctgcaagctgatgagggctggacaccccagttaccatttcaaaccacttattttccatgcagatgcttggttgcacttttccactcacctaaggtgcactccagcaaccaggacgtagaggaacatactcatcccgtctgagccccacatctcctggctgtgaaatccatggcttcttctcaggaggagaatctggggagcatagcacattgcaaacaagtgcccattgtaggaacagtaacttttctgtcggctctccctcaccttgcccatttatgaatctgaagtaagaaacgtgtgggggtgtgtgtgtttacagtttatattggaaggtattgtaggataaaatgttcggttggagagctataacctttttcggcagtttcatataaccaatgaaaagttactcatgtaacattttaaagctttcaatttaattgacaaaaattaatgaacaagtagaagagcagcataaacacttggaattattagcgagaacataccatgcctatgaatttgtgcaggaagaccagctcccatgggataactccttaaagttgaagactggaattttagcccagaattacttctggaaggccaatcccaaaagtcactgactaattgggctaactggaaaagaaaaattgcacaaaatgtcccttcaatatatacattaatttgcttttattttattttcaactaaggcttttgtatctaattgtattgatttgtacttccaacaaatgaaaaatcctgacggagaaaacatttatagagggcaattctaaatgaaaatagagataaagaagaaggaaaagaaggtcacatgtgctataaaatctaaaatattattctttgacaacctgttttaagatactacaatcacttaaaactcagtaaaaaataccatcttgaacactctcaggaactgagaattgcatgtcccaaataattgtcaacatgacatagagcttttgttttatgggaaggcagttcccaactgacaaatgggttgtactcaaaaagttctcttgaagttaattgttcagaacttggaccagctcacaaaagaaagttaaccctaagtgctccttggcctagtttgctagggctgtcctcacagaataccacagactagggctgcaacaacagaaatgtactgtctcacagctctggaggccagaagtttgagatcaaggtctcagtggaactggttcctattgagggctgtgaggaaaaattccgccttatgcctctctcccttcttctggtggttttctggtagtctttggcatttgatccctgtcttcatctttacttggtgttctccctgggcttatgtctgtctcagtgttcaaatttccattttttcagagggacacagtcacactgcactaggagctcaccctactccagtattacctaatttaaacttaactaattacatctgcaacaatcttgtcttcaaataaagtcacagcttggatactggaggtaaggacttcaatatgtgatctctggggagggagaacacaaatcaactactagcgtgcctaaacgttttgctaatacactccttcagcagcatcactgagaacttctctcagccattctgagccagatggctctcagagctcatagggcttctgcacttggaatgtggataagaggagggcaggaccgagtctttggagcccatgaattgtgaactccatatctgcataagccagggcagagcactgaaccacagtgctgcagaccagagttcaagtcccccggcaaagccatctgcctcctacagcaaaggttccaagatttgggatgcatcagggtcacctggagggtacgttgaaatgcaggtgacaggtccacagcccctgttcctgacttggcacatctggaatggggcccaggaatttgcatttctagtaagttcccaggtgaggctgatgcagctggtgctggagcacacttcaagaaccatgtcctaaaggatgcatgaatgaaaagatttggtttctgattaaaagaaaatacttacaaaggagataaaatctgtcttcccaggaaacacgtttgaaggaagaggaggcataataggttgaatagtggtttccccaaaacacaaaataggaacctgtaaatctgacttgatttggaaaaatgtttcacagatgtatttaagttaaggatgttgaggtgagatcatcctggattaaccatgtgggccctaaatccaataccttatgtcctccttgtcaaagccagacgaggagaatacactgaccctgagaaggccaagtgaaggcagagattggagagatgcaaccacaggccaagcaatgccaggagtcaccagaagctggaagtggaaagaaggatcaccccttaattgccctagagggactgtggctcagccagcaccttaatttttgactctggcctctcagacaataggaaaattaatttctattgttttaagccactcaggttgtggtactttgccacagcagccctaagaaattaatgcaagggaaaaactattcaaggagacaaaggaggtcaccatataatgataaaagggtcaattcagcaaaaaaaaagaacaattttaaacatatgtgcacctaacatgggagcacccagatacataaagaaaatattattagagctaaagagagataggtccaaatacaaaaatagctgaattcaacaccccactttcagcataggacagctcttccagacagacagaaaatcaacaaagaatcatcagacttaatctgcaaatggatctataacatagatccattattaccctgacaccaaaacagacaaagacacatcaaaaaaaaaaaaaagaaagaaaagaaaattacaggccgatatctctgatgaaatactgatgcaaacatcctcaacagaatgttagcaaatagattacagaccaaatgaatctattaataatagatatttatagaatatttcatctgagaattgaggaatacacattctttttctcagcacatggatcattctcaaggatagatcatttgtttggtcacaaaataagtctcaaaacattaaaacaaattgaaataatatgaaattaaacaatttgctccccaatgaccagtgggtcaatgaagaaatattcttagtttttctttttgaaaaatttcttaaaataaattataatggaaacataacaaacaagaacctatgggataaagcaaaagcagtactcagagggaagcatataggtataagcacctacatcaaaaaaagaggaaaaacttcaaataaataacctaatgatgcatcttaaaaactagaaaaacaagagcaaaccaaacccaaaattagaagaaatcacaaagatcagagcagaaataaatgaaattgaaattaaaaaatacaaaagaccaattaaacagttgttttttttttgaaaagttaaacaaaattgacaaacctttaactagactaagaaaaaaagagagaagacaaaaataaagtcagaaatgaaaaaggagacattacaacagatattgcagagtggctactatgagcaactatatgccaataatttggaaaatctagaagaaatgcacaaattcctagatatatacaacctattaagattgagccaggaagaaatccaaaacctgaacagaccaataacaagtgaggagatctaagtcatagtaaaaagtcttccagtaaagaaaagcccagaaactgatggcctcactgatgaattctacaaaacattaaaaagaactaatactaatcttactcaaactattccaaaaaacagagaagaaactcatttctcctcattctatgaggccagtattattaccctgataccaaaaccaaagacacatcaaaaaaaaaaaaaaaaagaaaactgcaggccaatatctctgatgaatattgatggaaacatcctcaacggaatgctagcaaaccaaattcaacaatgcattagaaagatcattcatcatgaccaagtggaatttatccctgggatacaaggatggttcaacatatgcaaatcaatcaacatgatacatcatatcaaaaacattaaagataaaaaccatatgaccatttcaattgatgctgaaaaagcatttgataaaatttggtgtccgttatgattagaaaaaccctcaaaaaactggaaaaagacagaacatacctcaacataatagaaggcatatacaacagacccatggctaatatcatactgaatggggaaaaactgaaagcctttcctctaagatctggaacgcaataagaatgcccagttacaccactgttattcaacatagtactggaagtcctagctagaacactcagacaagagaaagatatagggcatccaaagaaagatataaagggcatccaaactggaaaggaggaagtcaaattacccttgtttgctgatgatatgatcctatatttgaaataacctaaagactccacatgaaaactagaactgatagcaaactcaataaagttgcaggatacaaaatcagcatacaaaaatcagcagcatttctatttgccaacagtgaacaatctgaaaaagaaacaaaacaaataatcccatttacaatagctacacataaaattaaatatctagcaattaaccaaagaagtgaaagatatctacaatgaaaactataaaacacttctgaaggaaactgaagaggacaccaaaataaaggaaaatattctgtgtacatgaattaaaagaacaatattgttaaaatgtccatactacccaaagctatctacagattcaacgcaatccctatcaaaataccaatggcattctaaacagaaatagaaaacacaatcccaaaatttatggaaccacagaagacccagaatagccaaagctattctaagcaaaaaagaataaaactggaagaatcacattacctaatttcaaattatgctacagagctacagtaatcaaaacagcatggtactggcataacaatatacatataaatcaatggaatcaaatagaaacccagaaacaaatccacgcacctacaattagtccattttttacaaaagtaacaagaatatccactggggaaatgacagtcttttcaataagtggtgcttggaaaactggatatccatatacaaaagaaggagactagacccctatctttcaccatatacaaaaaaaagcaaatcaaaatggattgaagacttaaatctaagacctcaactatgaaactattacaagaaaacattgaggaaaatctcccagacattggtctgggcaaaaatatcttaagcaataccctacaagcacaggcagccaaagcagacatggacaaatggtatcatatcaattcaaggatacaatcaacaaagtgaagagacagtgcacagaatgggagaaaatatttgccaactacccctctgacaagggtaataaccaaaatatataaacagcccaaacaactctataggaaaaaatttaatagtctgatcaaaagatgagtgaaaaatttgaatagacatttttcaaaagaagacatgcaaatggcaaacaggcatatgaaaagatgctcaatatcattgatcagagaaatgcaaatcaaaactacaatgagatatcatttcaccccagttaaaatggcttatatccaaaagacacgtaataacaaatgctggcaaggatgtagggaaaagggaactctcatattctgttgatgggaatgtaaattagtacaaccactatggagaacagtatggaggttcttccaaaaactaaaaattgagctaccatatgatccagcaatctcactgctgggtatgtacccaaaagaaaggaaatcagtacatcaaagagatatctgcactcctatgtttattgcagcactgttcacaacagctaagatttggaagcaacataagtgtccatcagcaggtgaataaagaaaatgtgttacatatacacctgagccagggaaagaacttcccttcccccatagggacttggctgaagtcatcaaaaaggagacagtgttcgatggagttagcaatcccttgggaagcttcatcactgggaagatgagagcccaggtgagctggcagccatctttgctaccccgtggagtgcctacctgcaaaggaggcaactccgcatgcacccccaggacccaggctcacctcaggcaccccgggctttgctgaaacaggaggcatacattaaataaatttgagttgagtttctgtcacttgtagccaaaaatatcctaatacagacactgagagggaaggaaagagcataacctatgttgaggcaaactttatgttttatttttaaaaaataaaggatgataccctttagtgcttgggttggtagctaactttgaatgtgtgtgataagacattttttttcttttgtgtgtgtgtgtgtgtgtgtgtgtgtgtgtgtgtgtttggttttggtttacttcagagtgttctaggcatgttgagatacactaggacaagaaacaatgggcacaaattctcttaaaaggcatttctttaaccaaagcgtaagaaggtagaagttcccaaccatggcattggtttagtttcctgcctagatgtttctgtccacacaatggccctcatcacctgaaggcccaaaatccgtggagtcatgcagctgttaggtcaccagcagaatgtgacctgctcaggacggccttgcggcagaaaagccagtcctgacacatgaaccgtggctcctgggttatctgggggctggtatctcacaacactgctattaatcagttcattgccacattttcctctggggcatacataatttatgtatggcaactcttcctggaatttcattttaaaaacagaacaactcattccctttcgttttaagaaagtttttggtttgtgttgttagaagcaggctgaaataaacgaaggggactcaaatgtgagaggtcaattcaacaaatgtgcactcggtgtctctttcaagaaaaatgttatgctggggtagtgtggaagggtggaggggtggaggggacagagaaaactgtacccttccccaaagagcttacagtctagctggacagagaggacaaagataaagccaggggaatatgacaaacacacacatctcaaaaaagttcagcaaaaaaagacaaaaattttcatgaacctttagagaaggggtgtattcgggttcttcagaggacagaaccaatataatagatatagatatagagaaagaaatgtcttatgggaatcagctcacgtgattctggaggctgaggagccccacaatctgccatctgcaagctggaggccccagaaagccagtagagtaattcagtccaaagcctgaaggcctgagaaccaggagagaccacggcataagttccagcatgagtcagaaggccccagaaccaggagcactgatgtatgagagcgggagatgcacggcccagcccaaacagagcaaatgtgcccttccttctttttgctctattcagtccctcaatggtgacagcagatcttctgagctcagtctacctacttaaatgctaagctcttctggaaaccccctcacagacacacccagaaataatgcatccattaggtcaaattgacacataaaattaaccatcataagggattacacattcaactaaaattccagatgtatttaaaatttgacatgggccataaatagtagagggtggatatcttcaaatttccattttaaaaaaggattatactactcagtcataaaaagggatgaattaatggcatttgcagtgacctagatgagattggagactattattctaagtaaaataactcaggaatgaaaaactaaacatcatatgttctcactcataagtgggagctaagctatgaagatgcaaaggcataagaataacacagtggactttggggactcagggggaaagagtgggaaggggtgagggataaaagaccacaaatagggtgcagtgtataccgcccaggtgatgggtgcaccaaaatctcacaaatcaccacaaaagaagttactcatgtaaccgaacaccacctgttccccaactatggaaatacaatttttttaaaggattgtctatatcctttatatgctcacaatgatcattaatacacactttcagactcgtggtttttgaaaagttattgtcaagataacccattctaattgtgaatgaagagaagagaaaagtgggtagaatggaaaggagaaactggaaacgatcaaatgggagaggacaaaattattagctccctggactgggtagattttgagaactggagtaagacgaacatcggcgcgatccatgaggtttttagcactgtgatgacctcagtagcatctccacccatggatacgcctcaaacccagtctgtgtccttgggcctcacccaatgctcagtggcagcctccagaaagcatcatagctctacttaaatggaaaagaaacaattaaactatcacctcctaatgaatgcatggaggtctacttctcaggagttacgatttcccaggcctggaacaaaatttcagctcaggtaaatattaagaagatgaagttttaccatgagcacctgtagggcagagtctctccccagctttcataacacgcagcagtgtttgcatactgcatttaataacagctgttattataagaatcaagatttggcagagtctctataattttcaatagagtctctgtaattaaataatctgatgttttgcccaatcctcctcacttttatcccatttaaagtgggcatacgctgttttttccacatgcttcttttttctgttctcaatctttcatctttctgggtggcttcagatcccatgtttgagcctcattcttctcctctccaattaaacttcattcccggctctttatggaattcatagagaataactaaaacatctgacagatgcaagttaacattttctgggcaattttaattgacaatcagatggaactaatacctgatcaaccaattgacgtgataaaccagaaaaaagcaagaacacagaccgaaggccatgccaggaagaaacccaaaactactgacaaaacagataacaaattttttaacattttaatcattatcaactttggcatatgaataaatgtttgacatcttaccagttgtaatcctaccttgaactgccataagatgttatcagaaacatatgagaggaaattaggaggaaaagcctaaatcaaaaaatatcatcatttttatggcatttgtgctggaattatttctagaataatgcagtttcacagctataattcaaactatgttttagtctattggtttaactgcagcatatctgaagttaagaagtttttatagtgctcagtcccacagaatgatggttaaaaaccttagaaaaaatgcaattataatagacggcagttttgtcctttcttttttcttaaaaatggacttcatttgcagacctgctaaaccaatagctgctttctaactcccaactgtgttagtctgttctcatgttgccatgaagaaatacccaagactgagtataatggaaaaaggtttaattgattcacagttccacatggctggggaggcctcaggaaacttacagtcatggcagaaggcacctcttcacagggtggcaggagagagaatgagtgcccaacaaagagggaaactcctaaaaacatcataagatcttatgagaactaattcactatcgtgagaactaattcactatcacaagaacaggataggagaaaccacccccatgattcaattatctccacctggtccctccctcgacaccatggggatcggaacgataattcaagatgagatttgggtaagggaacagccaaaccatatcaccaatccagtgtctataacaatggcttggattactaatccagaaaagctacagagggacacataggttattaaatatagtatgagaatgtttttaaaaaataattatttaatactcttattcaggtaaaatagaatctgatcctaatgcagttttaaatatatcacatgataaaataattacacagatttctacaaatacatgtggcatcaataagaatccagaaaaggcccaatcatgctgagggctggaggtctcatcttttatcttaaggcaacgaagaagcagaactgaaagattccctaggcttgtgggatgctggtgttctggctgccaaggacagcttcatgcatgcccagtagctgtgctgatggcccctgctgtcctataggaggtgatgagagcaactggccgcagaggtggctcggcacctcttgttttcctttccacatccgcctcttaattagggccattttaaaaagctatttggaaatgggccgagcaggaagtgagtatcaggtagagttttgaggaaaggatttcagaattatttagagttcattcttagagattatttaatccaaatatctctgtttgatccaaggacatgaagtccaagaaattaagtagctcacccaaaaccaagtagctaattcatggcagagccattagaacccagcctctaggtcactgtctccagcagcttcccctacatcagggctcagacacactcttctcttctaagataaacatcctctgatcagaaccttctctcctccaggctgtgaaggtcttgggctggctgaagcaccaggccaacatgtctgaagggtgacaatgggctctcaggctgagtttgtactcaaatgaagagtagatctttattggtaggactcagctgagaagtaagttcaagtgagtcacatttattaatgtctatcttagagcctccatgtgcagtgctttattagtatacatgcattatgcagcatgagttgtttgcaatctggggcacagagaagaaccaatggctccagcagcctggcagtagtttcagtctttgtaagctcccacaccctgcagcaaagacctgcagcctttaactatggtctagtccttcctacaatgagatagtattaaatagattatgtcaaaatcaaatatttaagaaaggatacagcaaatatgaaatatacagtagatttatctcattaacaaagccaactttctcccttggagttacaattgtggggggcaggatttgcgcatttaagcaaagtagcatcatgccaagagctgtaatttatttcaaaactatgaagactccattactcttggtgaattttagaaatttcctttaaggggatcatttgtttgctattatactgcatgacaccttttgtgtgtgtgtgtgtgtgtgtgtgtgtgtgtgtgtatttagtcttatagtttctcatcctattttttagtatattttcatatgtattaaaagagatttgcaaagtgagtcaaatccatttttattttttaggacgtttttcagaattaaatatgtattcttaatgaattttttaaacatacacatacatataactagatactgtattaataatttaaagggaagagtaattataagagaagtttatttggattccattaaaatcatgtgtgtgagatgtgctatatcccaccaactcttcatacaagaatgctatggaataaagtagtagggaaagcctacctgtggtccagtgagatttctactggatttctcacaatcttagaatagtgctagcattcttgcaaattttgagagtggccaggtttatcaaggatggtcctcgctgccaccagaagcaggtccagttgatattccagttgctgtcactcacagctacagaacttgtaccatgctttctttaattccagacagcattctttctccttggtcaggcagttttgcctgtgttgggtcagtgaaccagtgaaccatgggtcacatggttctgatgagggcagatgagctttctagtcccttggttctgcatgtcaaccctcctcttttcatatccatggttagcattgactcctagttactgggatcaggaagcagagaagtttattaaattgctgatgctacaaaacgtatgggaatctggcaattttagatacccaataactagcccattaggctagtcatcctagagtacagagttccataaagacggtattaggcaccagactttgtcttttgtttttgactcctaatcggagaaggctaaaactttgctgctggatgcagtatacaataaactggttaatgacttaagctactcagctttattaagaatctactaggtgctttaccttttctggaagtctgacataaaatggttaagaacaatacacaccattgtgaaaacagcactgatgtctgctaaatatttaatttatgactgagatattctggataaaatccgttcccttcatgatgaaagcccatctgtgccctcaggagcattttctagtaaaaacactttctcattcttaagtgcctgcagcctgcccatccccctctttcgtcttccctgccagaggttttaggagaagaggaccacttctacacccttgataaaaacaattctgagaattagttaactgagacaggttgtaatttcctaccatggctaagttgctaagtaaatattgcaaagcaaacagaaaagatagaagcattcatttctcttccaacaaagaaaaacaaaaaggtagtttcttggatatgagaaacaaagggaaaaggggaaatcatcctatgtttgcttttttaaaataggctttgagtctcatatgcctttttttattattttgttccagttttattttggttttgcttcaggtaaaaaaaaaattggaggcctgatattacgctaagtgaaatattacataatctcacttttgtgtggaatacttctttaaaaggtcaaatatagacagaatggtaccagtagttaccagaattgggactagctggggtgggtggcatgagaaatgcggaaatataggtcaaaggatgcaaagtggcaaatatgtaccataaacaagtccaaagatctaactacaacatgagggctatagttaataatagtatatcatattcagcatgtttgctaatgtgtatattacagctgctcttacggtggggtatgggtaactatttgggatgagggatttgttaatttgttccactatagtaacattttaccatttctatgtatttcataatatcatattgtataccttaaatatatacaataaaatttatttataaagaaaaagaaaagttacagagcacactaagtccctgtttttccctgatagctcttgagggaagagatggaggtttgcattgaagtgggaaggaagccaggatgacttgatcctaatgcaaagttagagtgaaaaactcacccaggcttcacacaaaaccagcacagagaagtagtcaggtttctctccaaatgaaagtaaaatgtaaaagagctcccacatgttattgagctcatacatgtgctatgaaagatacagagaagtaagaaatctgaacctaccttcaagtcatttaaactctactgtggtacatacataagtcattccctacaggaaagctaggtaatggcaaaggtggaacacacaaagtatgcaatgagtggttcttaaagcaagtagcatgggatgattttcctctctcatgtccttggctccaagcatcatcatcaagatgagctttcctatattggtatacccgtttttgacctctccattgaactccttatctatgtgttcaacttcttgattgacatctccacttgggtatcaacaggattctcaaatgttttccctagatttacttctccactagtcttctccatctcagcaatgattcttcccctgactcagcttctcaagtgaaaagcctggcaatcatctttaatgtcttggttaacctgacatgacacatccaattaatccttaagtcttactggctctacctccccagcttaacctgaattcacccatgtcctgccatggccaccaccaccgccatctctggcctccactactgcaatgaccttcttccttcactcctctccctctatggtctgttctccataatttaggcagcagtcatttccccaaccaccacagggcctttgcaggagtgcttcccagccaagaatgtacttctctaagagccattctcatccttctgctaccagctcagatgttctctactccccacccatccagatcagctaatcggaaggaacagtgggtcactctctgttgctccatccaatcttacctcagaactttattacaatctgctatgttattatttaataatttacacgttgactgcctgtcttcccatttaggatgtgcattccagagagcagagaccgaatcctactggcttgtcactatggattgagtacctggaataaagcctggaatatagtaggcacttaataaatgttggttaaataagtaactagatgaatgattgttcctctctacactgaaatcaaccaacacgtcaacataaaaaaaaatggaagcacccacagatttttgtaggaaggccctccttgcctttacacattcacgtccaactcactgctccctggtcccaggctccctctctcagtatgatcctgctcctgcccttggatcctgcttaggccccaccacctcctgcctctccacttattctcaagttcctggggaacactcccacagggaagctcaagaggtatcctgcagcaggtgagctgctctggagcccaaaaccacccacaggcctggtgcatcacctggagggctcccctgacctccattcaagggtttcagacagggtcagaagataccatcacatattaagaagaaaggaggcttcctagagaagcctaatggtaactgggccttgcaagctggtgaatacaatgacctcccttaacgtatattaatgtttctcaaccttgttttcatcatcgcccctccccagcatggagccttttcagtcttttcacccccttcccacaaaatctgaatggcacagatatgctatatatctgtttacatactacagcctttcagagagccacaagccattataatatctaatattttttccacccctttcccccaaaaatcaattttcccttttaggggtaaatattgcctctgttgaaaatgcaggtcatatgtgtgtttctcttgtgtgaacagtgatgtctttctgttatcctatggatggtaggcaaatttccccttcaagaaaaatattttccagtattggttatttgagaatgtttggatccctttaggggaaaaaaatttgaacccctaaaagagggcatccagttggcagaagaagaaacacttcatccctcccatgactttgctctttatctccagactttaaggaatccagatgtctttgaagggtgagaggtggcccctgaatcacagggaaagctgggcattgggaatgcccggctttcccagagcagacattacctaaaaatgagaaactgtgtttggtgggctagacattatttcatgttattctgttcgctatctctatgaattcacgagtcagcaagggtaggaaagagaggtgaggaagacagaagagcgagcatgcagtgcgccctccatgggatcactgaggacagctgactccttcttctgagggaagggcagcatcacaaaggggatagaaatggaattcggcctgtgtctcaattttgtaggtctggcacctgcttacagccttgattttaactgaaccaatctagctgtccttccttcactcactcctttcaataaatattgagggtcaagtatttgtgagtactaggaaatgcaaggtcaggaagatgaactttgtttcccaaagagcctgctgcaaacagggaaagcacataggtgattatattaggagaacctgtgagtagaagcacaaagttcccccagagcatttgcaccagccctccatattgtcactcaccaagagacaggcagtgtttcttatttcaagaatgaaagcatcttttgggaacttttttgtacttccacgtttgtacttccaaattcattgtttttgaggaacataatcaagtagcataatgtcaagctgctgcctaaattaagatctcttccttcatttcactctcaccacaaaatcagtgattacaatcaaataaacaattacctttgtctggtaaaatctgcttttaattaacctatgtttgttcctcactgaaaatgcctccatgaagagtgcacctagtgagtccttctgctccagtaccttgaagaacagacaggcaataagcaaatggcctaatggccccatagctcctccattctcaagaccataaatctcaaaaaaatcaggtctgcacatgcagaaccagaaaccggagcttgccataggctgcttttgaggacacagagttgtctggagaatgggagaaagggaagactggctgtgaaggatggaagaggctctataagaagaatcaagactttaatctgcctggttataaaggtattatgtcagcttcataaggtgttataatgacatttttcctaatctcttgacattttcacatcattagaaacaataaatctcttcctgatgagtcacacattgtccaaaagccatggtcactttgaagtttcaaccaaaagaggaaattttatcaacaatacaaacagcccagacttgagcagacatttatccaaagaaaatatacaaatggccaaaagcacatgaaaagattctcaacatcaataatcattagaaagagcaaatcaaaaccacaatgaaataacacctcaccgcccatcaggatagttgtaatcaaaaatacagaaaataacaaatgttggtgaggacgtggagaaatcggagcccttgtgtgctgttggtaggaatctaaaatgatttggccactatggaaaatagtatgatggtttttcaaaatgctaaaaatagaactaccatatgatcccacaattccacttctaagtatttaaccaaaacaattgaaagcagagtcttgaagagagatttgcacatccatgtctgtagcagcactattcacaatagtcaaaagggagaagcaacccaagcgtccattgacagatgaataaataaacaaaatgtgtcacaaacacacaatggaatattattcagacttaaaaaagacaaggccaggcacagtggctcatgcctataatcccagcactttgggaggccaaggtgggtggatcacctgaggtcaggagttcaagaccagcctggtcaacatggcgaaactctactaaaaatacaaaaattagctgggcctggtggcgggcacctgtaatcccagctacttgggaggctgaggcaggataatcactggaacccaggaggtagaggttgcagtgagctgagattgtgccattgcactccagcaagagtgaaactccgtcagaaggaggatgaggagaaagaggaggaggatgaggaggaggaggagaagaagaaggagaagaaggagaaaatttggacatgtactacaatatggatgaacttggaagacattatggccaagtgaaataagctagtcacaaaaaggcaagtactgtgagattccacttctgtgaggtactacagaactggacacttaaaaatgattaagatgttaaattttatgttatgtgtatttttaccacaatttttttaaatcaacaaaccaaagaataaaaatataaaaagagaaaatatgctggcattaactattaaataccacatgtttagctaccaaggattcttttgctccatgcatccccaacccagcttcttctccccttcatgccatcatggcctggctgttatgtggggcaataagaagatatggagatggagatagaaatggagagagacagtgagacagagacacacagagagagaaatatctgtatccctctcttctatgtgaataataggacttgaatgggattaaatacttatccaaaggagcctgagacttttaccaaccagattaatatgaaaatcactagacttggttaacttaccataagtgactgacattttatgagcaggcaacatcttgattcccctcaccccatgtctggagaaaaagattcaaagaagcaagttgatggcagttttagaaaacagcaaagtactcccatatttgtattttactgaatgaagactactcaactatgagtctaggtttatgccccggcatacgaatgatctttgggatttagtctgcaattaggaaaagctgctggcacttggtggtaatagttggtcacattcatgtgtgctaaagagatggcagactctatagcaggagttttcaaccaggaatgacttcaccccctaggagatgtctgacagtatacagagacatttctagttgtcacaggttggaggttgctactggcatctggtgagtgagccagtgatactgctaaacctcctacaacacataggacagctgcctacaacagaaaatgatctgagccaaaatgtcagtagtgctggggtagagaaactctgctgcagatgagattcaccagaaacggggacaactgcagtttcccgctttggttcctgtattaaaatagctaagtgaatatgaaaaataaaatggtcacataaatcagctacatagagaagtctggtcctctgctagggaggttgaggggcagcagcttctctatcaagtccacccctactgcggccagctttcccagccagactcagccaagcatctgccatgcagcagcaggctaaccttgcttgttctattttggagttgcagaggccaacagagcagctagcctgctgaatgattcctcaatgaacctgattctgaaagcccttttctcaccctacctgagcttccctgctgggcactcctacacagtcaactcctccctccaggaagcaagatcctcccagagttcaacagcttgtcctaaagcttacatttatggctgcctcttgcaagcctagggctgaatctaaatggccattaagaaggcataatcctctcctgcagaattcctataagaattatcagcagaatagcagaagtgtgtagggcagggacacatttagctgcaagcatatttcaatattatggtctcaggtttgagagctctgtttatactgtgtaaacaactttctgggtacaaattaatattctgaagattaacaattaactgtcctttatcctgaattgatctaatactcgagatcaaattgatcaccaagcttgaagagaacatgacttttgaatattctgaattcctgcttgcacctaccaatcgtttctgtaataattttatgtctatcacaacataggatcagcagaagccagtaagtaggacctagattcctgagaggctggggattaatgcaaagacctgtgaccttgtatctgcatatgttctgtattttttttttcaattttgtgggagttttcactaaatttcttggtattcagaaaggatccttgaagatattaggaatcattgctttagagtatatgcaattacttcagtggaaatgtgatttcaaatttattctcagcaaatttgaagaaacaacagcccactcagctcctctgtacccagactgtagaatctgatctacagcagggtttccctaccccagcactaccgacactttggctcggatcagcttccaagttttagaagaagttgggaacgtgggaactactctatgtcttctaagtgtttctggcaatctgctctccatcttctggccactctatgctttctccactgtaatcacaagccagcccttcccatggtaaacaagaccactcattaaaagaatattatttattcgcccctttagcatagcactagagttccatcagacctctacattccaccagttcaaagaagaaaaaatatgtatctccatgtaaatgcatcaccccacaaaaaaaaaaataagatttaggttgactatttctctccaacaaatttccccatcattttctatcttctgaagatgggcaaaaagttgttattgaatttcttcccttgttttatttaatttgaactcgaatttaaatgcagtggttccccaagaaactgttacagcctgaggttttcatagccagtttcgagctacaaactcaagcttatctacaaatgtacatttttaaataatactgaaatagaacttacaaactgagattctagtgttttcacaaggacgatttattagtaaacaaataaaaaaattgagaaagtaaagttttgtgtatgaaagtaagtacactgttccagaaacgccatccctctgaatgtgttaggtaaggagctgagtggactgatgtttcatcagatttgctgagaataaatttggaatcacgtttccaccaaagtaattgcatatcctctagagcaatcgttcctaattttttcaaagatcctttttgaataccaagaaatttagtgaaaactcccacaaaattgaaaaaaatgcagaatatatgcatatagatgctcacaggtcttcacattgatccccagcctctcaagagtctgggtcctacttactggcttctgctgatcctatgttgtgatagacgtaaaattattacagaaacgattgtcccatgcaaacatcctagaacttgctcactgctcctattaaaacttcacagataactgtgcctacatcttatctgcctatgttagaaaataaatgtcctcttctttttcttcagtcttcatacatagtctactattgatgttttatgccctataaatttacctttctaatactctctaattaaatctaaaaactgcttgccttcttcttaagcatacagttgagttgtgagaacccatagacttcatgaagggcctttctatatgcaaacaataaatgtgataactgatcattcccaccattgggatgattatctacataaatcttaagtgcaccattgaaagccacattaaatcatcctgctggtccattgcattgtgggagataagtcagcacttttacatctttaactgaactgcagtatcccaggaaattcacaccctcgtctgcaaaaatctcccaaagaaatccaggccaaaattgaaccatgccaattctcaccgatcttgtaggcataagaatgcaatgtcctgctgcttccctagtcccttatatcatgaaaggtgcttccacaataaacgttatgcacttttaagaggcattttctaattcctaagcgctctaaaaaaaaaaaaaacttcgtactgacagatcaagaagactgtgggcggtttggtcattcttcttttcctgcctctggcacacctcaccacctacatattttcatgcatctggctttggatcatagaatcctagacattatttgggtggcatggattcatgaacacccataaacttggatgggggaaaaaatgacatctttattttcattaacttctaacttaaatttagtatttccttcaaatatgaatgcaggcagcaaacctagtctcagagactttatggccaagagaaatcacagatattttcatatcacattaagcttgtgcaggtatctcaaaatatttactctcatcactatttcaaaatttcagtcgctgttagagctgccatgagagcttgctgtttaatgtggtaataaagcccatatatcacaaccactaaatccccaatttgaggtatatatatatatttgattattatatttaaccattatattataattggtttccttagcaattctatgtattttattttatgcatttaaaaacattatttggagaaagagtccgtggcccttatctgatagccagaggtccagggcacaaagaagatttgctttcttccctgactcatcacggccacatcctccagtaccctgcattgttttcaatatactactttaaggagccctggatacctcctgtgtgccctgtgtcgtagggggctattcctgtttggcctctacagatgagatattctgagcagaaggtctgtccaggtgaccttatcttttttttttttttttaacttttgcaaatcttgtttattatagaaagattatagtggttaaaaagcttccagttttataagttgacctcaaaacagtgtaattgtgtgtgtgtgtgttttcttttctttaaattttttttataatttttatttttaattcaggggatgtatgtacaggtttgttacaggagtatatggcttgatgctgagacttgtggtgccactgatgctgagcatagcacccaataaatttttaaaccttgacctcctcctcccctcccacctctagtcgttcccagtggctattgttcccatctttatgtccatgagtcaggtgagctcatcttgatagtcaccccttgtgactttttttccacaccttacaggggaaatggcatggttctccaacggcctcccagtcgttagcaggaatgaatgagggcccttggagaacatttcatctgcctcctagttacagtcaagtcaatagaattccagagagcaacacaatggcctgcctcagattcccacagatagtgaattgccctgactagttaattagaaagttcttttctatatattacacatggacaaatacaatgactagcatttcggtgtattttttatttttttaattgacacataatagttgtattatgtattatgggatacagtgtatgatgtttcaatgcatatatacaatgtgtatttagcatatatacaaggtatttagcatatccatcacctcagacatccatcacttctttgtggcaagaccattcagaatcctctcttctgtcttctttgaaatatataccatagcattgtttactatcctcaccctactatgccatagaacaccagaacacattcctcctatctaactgcaaccttgcaccattgaccaatctcactccatcatccctcctccctaacccccaagcctcacacgactagtgttttttcatgctcattgtttaccaggtactgttctaagtgcttgacatgttaactcctttcattatcacagtggcccccattaggtaagttctataattattcatattttaaagatgaggagatagaggaagagagtggttaagagacttcctagtctacatcaagcagtgatgaagccaggatccacatcaggctgtcacttttcccccagcccctttactgtcctgcctcccaacccactaccaccacagagcatgtggaagctgattaaaaaacaaacaaacaaaaaataaaaccacctcagcaccaaactgagcagaggcaatccccccaaggtgtctttggcttgcagagatcaaacagttttctcatcatcttgtaaaatagggatacaaaggcctacctttcaggggtggtctgaaagttaaataaaacacatgtatcaagtgctaagtgtgttcagtgcataagttccccaaaacagtagttattacaatatttgctattatttttgtcaagatgtacacaaaagatagtggacaaagaagagatggatgatgaataacaaaccttcagggatatgggaatgagcagaaaatcatggtcaaagtataagagaggtcatgcaatccaacccacatttatgccagtctactgggcccctccaggctcctgaggtttaaaattgacctattgcctctgtcttcccctagatttgtccctgcaagtgtttcccttccttcgtgaaaattgccatattggccttctttcacctgctttcttacctccctcctccaagttccatccacaaatcctgtcaacccgccccagaaatatctcaaacagttcaaaacataattcaagcactgaatttaattccctttcaaaattagctccaggtgaccaaagaaaatccatatggatgctggaaaattggaaaggttgaaaacgacatttaaatgatattcaaggatttcccacatggaaagcaagaccagccagaataggagtctctggcccacaaccgccaaatgcaaggggaaacccacatgggaacaagtagcagggagcctcagcaaagccacccagcacttcctggcttgggaagtgtgagggatgtcagtctgttttgactatttcacctcctcacctccttctttgagggaactgtgcctattccactggtgtaattgcacaatgggttcttcttgtcctctgcacaaataaacccgttcactgagacagcatcattgcagcaaagaaagagtttaacacaagcctgaccaagcagaaggacagaagttttttattactcaaatcagcctccctgagaactcacaggctatggttttatggataatttgttgggcagggggctagggaatgggtgttgctgactggttggggatgaaatcttacgggtgtgataaatggtccttgtgtgctgaatctgtctctgggtgggggccacaggaatggttgagtgatgagccacaggtctgggtggggtcagttagttgccagaatgcaaaagtctaaaaaatatctcaaaagaccaatcttaagtttcacaatagtaatgttatctacaggaaccattggaaatatcacaaattttgtgacctcaggccacgtgattcctgagcagcaagggattacagaaagacaagcaagaggacaacagctggttaatgtttatctacacctacatcttagcagaatctagttccctcccataatcctaatcgtgtggcctttcatttgtcttacaaaggtagtttcagtcctcaaccaaagagaggatcagttttaggaagggaccattatcatccttgcttaaaacttaaattataaactacatttctcccatgggtagcttggcccatacccaggtataagcaaggccagccagctgtgagactagaagcaagaggagggtcagtcatgctagatatatcttgctgtcataatctttgcacaggtggtttcagtggggctcccaaccacaggatttgccataccctaaccacagaggtgggtatgagactgaggtaagtcaaatagactttccctcctgagaattcaaccttggttgagacacagagggatgagaaagggtagctgaaccattgtaataacaccaagatctccagaactgcactatgtctggctctcccatgggtgcagtccacggaatgtgagccgaagcacgggcatcgcctcacctgggaagcacaaggggtcagggaattccctttcctagccaagggaagccgtgacagatggtacctggaaaatcaggacactcccaccctaatactgcgcttttccaatggtattagcaaatggcacaccaggagattatatcccacacctggctctgagggtcccatgcccatggtccatcttcctttgattttataagatatctcagtgctcctggtgtttatttcactattatgtttcataacacatgtgtacactacatatatccttcaataatacataaatcaatatttcataatcaacattaaagaataaaagagccaaaacaagagaattttaaaatatttgctctcagatagtggggataggacttgctacagactcgaatgaaaggaaagaattatgtgctaattctgctaaggaaaatggaaaccattaaaatgccttaaaagaactaaagaaatgaaaactctaaccaggtaagaaagggagttagtgggatctcagtgaggttgaagactccacacctcttacacttaactaaaacactgaaccctatggacatgggctgctagatcatctcattgaaggatgtggtctaggagacccaatagtttctttataggcaaccattaaaaagaccagcatgtctatttcatccacaggaagacccgagcatccaaggcatgaatcacacaacaaattctcttcaagaaaagcaacgaggttccaagatggctgaataggaacagctccagtctatagctcccagtgtgagcgatgcagaagatgggtgatttctgcatttccaacagaggtaccaggttcatctcactggagcttgtcagacagtgggtgcagtccacggaatgtgagccgaagcaggggcatcgcctcacctgggaagcacaaggggtcagggaattccctttcctagccaagggaagccgtgacagatggtacctggaaaatcaggacactcccaccctaatactgcgcttttccaatggtattagcaaatggcacaccaggagattatatcccacacctggctctgagggtcccatgcccatgaagcctcgctcagggctagcacagcagtctgagatcaaactgcaaggtggcagcaaggctgggggaggggcgtccaccattgctgaggcttcagtaagtaaacaaaatgcccaggaagctcgaaccgggtggagcccaccgcagctcaaggaggcctgcctgcctctgtagactccacctctgggggcagggcatagccaaacaaaaggcagcagaaacctctgcagacttaaatgtccctgtccgacagctttgaagagagtagtggttctcccagcatggagtttgagatctgagaatggacagactgcctcctcaagtgggtaactgaccgaaaagcagcctaactgggaggcacctcccagtaggggccaactgacacctcatacggccgggtgcccctcgagatgaagcttccagaggaaggatcaggcaccaacatttgccattctgcaatatttgttattttgcagccttagctggtgatacccaggcaaacagggtatggagtggacctccagcaaactccaacagacctgcagctgaggtgcctgactgtcagaaggaaaactaacaaacagaaaggacatccacaccaaaaccccatctatacgtcaccatcatcaaagaccaaaggtagataaaaccacaaagctggggagaaaccagagcagaaaaactgaaaattctaaaaatcagagcgcctcttctcctagaaaggaacgcaactccttgccagcaatggaacaaagctagatggagaatgactttcacgagttgagagaagaaggattcagacgattagtaaacagaaacttctctgagctacatgaggatgttcgaaccaatcacaaagaagataaaaaccttgaaaaaagattagatgaatggctaactagaataaacagcatagagaagaccttaaatgacctcatggagctgaaaaccacggcacaagaactacgtgatgcatgcacaagcttcagccgccgattagatcaagtggaagaaagggtatcagtaattgaagatcaaatgaatgaaaagaagcgagaagagaagtttagagaaaaaggagtaaaaagaaatgaacaaaggctccaagaaatatgggactatatgaaaagaccaaatctacatctgattgatgtacctgaaaatgacgcggagaatggaaccaatgtggaaaacattctgcaggatattatccaggagaacttccccaacctagcaaagcaggccaacattcaaattcaggaaatacagagaatgccacaaagatactccttgagaagagaaactccaagacacataattgtcagatttaccaaggttgaaatggaggaaaaaatgttaagggaagccagagagaaaggctgggttacccacaaagggaagcccatcaaactaacagcagatctctctgaagaaactctacaagccagaagagaatgggggccaatattcaacattcttaaagaaaagaattttcaacccagaatttcatatccagccaaactaagcttcatagtgaaggagaaataaaatcctttaaagacaagcaaatgctgacagattttgtcagcaccaggcctgccttacaagagctcctgaaggaagcactaaacatggaaaggaacaactggtacaagccactgcaaaaacatgccatcgtaaagaccatcgatgctaggaagaaactgcatcaacgaacgagcaaaataaccagctaacatcataatgacaggatcaaattcacacataacaatattaacctttaatgtaaatgggctaaatgcccccagttaaaagacacagactggcaaattggataaagagtcaagacccatcagtgtgctgtattcaggagacccacctcatgtgcagagacacacataggctcaaaataaagggatggaggaagacctaccaagcaaatggaaaacaaaaaaaaagcaggagttgcaatcccactctctgataaaacagactttaaaccaacaaagatcagaagagacaaagaaggcaattacattatggtaaagagatcaattcaacaacaagagctaactatcttaaatatatatgcaccaaatacaggagcacccagattcataaagcaactcattagagacctaaaaagagacttagactcccaaacaccccactgtcaacattagataaatcaatgagacagaaagttaacaaggatatccaggacttgaactcagttctgcaccaagcagacctaatagacatctacagaactctccaccctaaatcaatagaatatacattcttctcagcaccgcatcatgcttattccaaaattgaccacatagttggaagtaaagcactcctcagcaaatctaaaagaacagaaattataacaaattgtctctaagaccacagtgcaatcaaactagaactcaggtttaagaaactcactcaaaaccacacgactacatggaaactgaacaacctgctcctgaatgactactgggtatacaacaaaatgaaggcagaaataaagatgttctttgaaaccaatgagaacaaagacacaacgtaccagaatctctgggacacatttaaagcagtatgcagagggaaatttacagcactaaatgcccacaagagaaagcaaaaaagatctaaaatttgacaccctaacatcacaattaaaagaactagagaagcaagagcaaatacattcaaaagctagcagaaggcaagaaataactaagatcagagcagaactgaaggagatagagacacaaaaaaaaccttcaaaaaatcaatgaatccaggagctggttttatgaaaagatcaacaaaattaatagaccactagtgagaataataaagaagaaaagagagaagaatcaaatagatgcaataacaaaagataaaggggatattaacaccgatcccacagaaatacacactaccatcagagaatactataaatacctctatgcaaataaactagaaaatctagaagaaatggataaattcctggacacatagaccctcccaagactaaaccaggaagaagttgaatctctgaatagaccaataacaggctctgaaattgaggcaataattaatagcctaccaaccaaaaaaagtccagaaccagacggattcacagccaaattctaccagaggtacaaagaggagctggtaccattccttctgaaactattccaatcaatagaaaaagagggactccttcctaattcattttatgaggccagcatcatcctgataccaaaggctggcagagacacaacaaagaaagagaattttaaaccaatatccctgatgaacatcaatgcaaaaatcctcaataaaataccggcaaaacgaatctagcagcacttcaaaaagcttatctaccacgatcaagtttgcttcatccctgggatgcaaggctggtttaacatatgcaaatccaaaaacgtaatccaacatataaacagaaccaaagacaaaaaccacatgattatctcaatagatgcagaaaaggcctttgacaaaattcaacagctcttcacgctaaaaactcgcaataaactaggtattaatgggatgcatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaatcaagaaaaaaggaagtcaaattgtccctgtttgcagatgacatgattgtatctttagaaaactccatcgtctcagcccaaaatctccttaagctgataaacaacttcagcaaactctcaggatacaaaatcaatgtgcaaaaattacaagcattcctatacaccaacagcagacaaacagagagccaaatcatgagtgaaccccctttcacaattgcttcaaagagaataaaatacccagaaatccaacttacgaagtatgtgaaggacctcttcaaggagaactacaaaccactactcaatgaaataaaagacacaaacaaatggaagaacattccatgctcatgggtagaaagaatcaatattgtgaaaatggccacactgcccaaggtaacttacagattcaatgccatccccattaagctgccaatgactttcttcacagaattggaaaaaactactttaaagttcacatggaaccaaaaaagaaccttcattgccaagacaaacctaagccaaaagaacaaagctggaggcatcacactacctaacttcaaactatactacaaggctacagtaaccagaacagcatggtactggtaccaaaacagagatatagaccaatggaacagaatagagccctcagaaataataccacacatctacaatcatctgatctttgacaaacctgacaaaaacaagaaatggggaaaggatttcctacttaataaatggtgctgggaaaactggctagccatatgtagaaagctgaaactggatcccttccttacagcttccacgaaaattaagtcaagatggattaaagacttaaatgttagacctaaaaccagaaaaaccctagaagaaaacctaggcaataccagtcaggacataggcatgggcaaggacttcatgtctaaaacatgaaaagcaatggcaacaaaagccaaaattgacaaatgggatctaattaaactaaagagcttctgtacagcaaaagaaactaccatcagagtgaacaggcaacctacagcaagggagaaaatttttacaatgtacccatctgacaaagggctaatatccagaatctacaaagaacttaaacaaatttacaagaataaaatcaaacatccccatcaaaaagtggacaaaggatatgaacagacacttctcaaaagaagacatttatgcagccagcagacacatgaaaaaatgctcatcatcactggccatcagagaaatgcaaatcaaaaccacagtgagataccatctcacaccagttagaatggcgatcattaaaaagtcaggaaacaacaggtactggagaggatgtggagaaataggaacacttttacactgttggtgggactgtaaactagttcaaccattgtggaagacgtgtggtgattcctcaaggatctagaactagaaataccattagaactagaaatgccatcccattactgagtatatacccaaaggattataaatcatgctgcaataaagacacatgcacacgtatgtttattgcggcactattcacaatagcaaagacttggaaccaacccaaatgtccatcaatgatagactggactaacaaaatgtggcacatatacaccatggaatactatgcagccagaaaaaaggatgagttcatgtcctttgtagggacatggatgaagctggaaatcatcagtctgagcaaactatcacaaggacagaaaaccaaacacagcatgttctcactaataggtgggaattgaacaatgagaacacttggacacaggatggggaacgtcacacatcagggcctgttgtggggtggggtgagggggaagggatagcattaggaaatatacctaatgtaaatgacaagttaatgagtgcagcacaccaacatggcacatgtatacatatgtaacaaacctgcacattgtgcacatgtacactagaacttaaagtataattttttaaaaaaaaaagaaaggaaaagcaacatctttctgcttaggatgagagcctaatatacttggaatgataaaacttctttttcagtgagtatcattttacccttggaaccttccaaggtttcaaggtattttaacacgcaagtattttaagtattttaaggtagattacacacatcttaacacctaccctataatacttgagcacacacagtgtgatgccataatatgttagtttaagttataaactaggcacagccagtggcctgatggagactccctagccagtcagcaggtcaccagcaaatccacacaccagagagggctacagtaagagcgtcagccaggcacatcttcatcaacatcaaaggcttttctaactgacctagtgaagatcagtggtttctgttggtggaattaatggtattcaagttgtatgatagagtaagatatttcagtaaatatccccacacttcatgaacagcacaagcatcccaggaaatgatgccactcaacatttaatgtcccaagagtcccaggtcccccaccaagtcaggagcagtctggactgcagataccatcatatctaccttagatgaacctgccatgcaatcggtcagactacgcacaagacagagaacatacaaaaaatgacccgtataggagataacgcatatgttaattagctcaattcagccattacacaatttatacatattttaaaacatcatgttatacatgacaaatatatacaactttgtgaattttttagttactttttttaagaaaacagaatagggacttcactgagctcacaggcttgataataagtgttcattacatgtccagatggagggaagagtttggtcagccacgtgctttgcctataacctggttgtgccactgtcttccacctaaaagaacctgagagtttctgataatcaaacaggaaagctcaccacaaaaggttagaatagcaatgcctttatgttacattaaataataatctgcatatgttcagtatttatagtgtttagggataattttgtctataaaaaccaacagattagctttatgattccattaaaatgtacttattttctatttgagattttaagctgaaagatttaagggtcttgtctaggtttgtacacagcattggatgcttaagataacttgagatttactatattcataagattaatttattacattacctacagaggggaaatcaaatatattatatttataaatgcaataaaaatgtttaaaggaatttaattaaccaagttgtaaatggggctgattatttaaggtagttttctctgttcagctggaacactaagaaaagcgtccttgaacaggattgctgaaattcactggatttataaaaagaacaataagatttataagtggcacttctatgggcttaaggaaaacaagactttttaatttattatttgaataaattgtaaacgaattcataataaaagtccaaaataaatgtaaatcattcctttcgggggggaaattaccttaaagaccaaaaaactcacagcaacagatcagaactatgaatcattattaattgagatgttggcattattctcccacagaaagaatcacagcattctacaacagttgttgcccaactcttttgattatgcacccctaatagtaaaagaagtttgaaaatgtatctgtaatatatgtatatttattgacacattgtgatgggcactgccacgcactgcccagagtccccagagaaggacatgttgccctgtgctgtgggcagagagcccccagtgatcagttcttcagggatgctgcaactgcagagggccacctggatgaatgcatgtccctctcaagacagcctatatgcagtgactcatccgtgcaggtatataaaggcctggccacctgggcccagctctagagagctctgaagggccattctagctcccatgctctgcatggcgttgacccaggctgtcacagagcctgtgtcacagatggacctctccttctgctccaccctgattccttctgtccttcgtacagatgtcaatgcccaggttatgccctagcaaacatcccacatgctccactccttcccagagtctacttcccaggaaacccaacctgtaacacaaactacatatgcaaacatctcaattactttgttaaacattagcaaagcttaatatctttatgatttgaatacctcagcctcggaaatggtagtgaggagaccagaatgctaatgagccataaagtatggataattgagagattacccttgtcatatccattatggctgctataagaaagtatctcacgaggtaatttataaaaacaaatttatttctcacacttctgaagactgagaaatccaagacaaagatccactgccagatccactgtctagtgagggctcgctttttgcttcaaagatggcacattctaggttccctcacttggcaggaaggggcaaagaaactccctcaaacacccagagggcagggcatgcggccccaccaacccctaccactgatagtcaggtgggaatgccagagcttccagcccaatgatcttgcttctgtgtgaactcagctagaggccacaacttcctgttgtcccaggagaaactcaatggcagagcatgctacctcgcccactccctccacaggtagccaggtgggtaggcaacacctgctacagcttctggcccagtggtcccacttctgtgtgaactcagccagtggatacagcctcctattgtaccatgaagcacccagacagcagggcaggtgcctccatccacctctaccacagggagtcaggtgagccatgcctgctagagcttccagcccaacagtcctacttctgcctgaatttgccaagaggcacaacttcctgttgccctgggaacaccaggatggcagggtaggcaactctccccacccttgcttcctacagccagaagggccacacccactagagcttccaacccagtggccctacttctgcctgagctctgccggaaggtacaaacctgtgtttccccaggaagcaaacaaacatcagattagggccaatctaggaaggataaggcttatctgccaactgtggcccctgcttgacagagtctcatggaccaaaacacccaacaaaaaaacatgggcatggagacagtaattggagggggctcctccaaagagcctgtagcagactagaactgaaaccagtcaaccaaacccaccttacaccatcatcaaatccccaagggcatcaaagaagcaaaaagcaaaaaaaaaaaaaaaaaactatccaatttatctttgaaggatagcaacttcaaagattgaaggaacatcaggtcacacaaatcagaaagaaccacagcaagaactctggcaactcaaaaagccagagtggcttctttcctccaatgaccacactagttccccagtgtattagtccatttacacactgcaataaagaactacctgagactgggtaatttatgaagaaaagaggttcaactgaatcacagttctgcaggcttaacagggagcatggctggaaggcctcaggaaacttataatcatggcagaaggggaaggggaagcaagtacatctttactgtggcagagcaggagagggagagagagagaaagaggagggggaagtgacaaacacttttaaaccatcagctctcatgagaactcactcactatcactaaaacacctcccaccaggcccctcctccaattcgacatgagatttgggtggggacacaaatccaaatcatatcacccagcaagggttcttaaccaagctgaagtggctgaaatgacagaaatagaattcagaatatggataagaatgaagatctttgagattcaggagaatgtcaagactcaatccaaggaagttaagaatcacaataaaataatacaggagctcatagacaaaataaccattataaaaaagaagcaaactaatctagtagagctgaaaaatatactataagaattgcataatgcaatcacaagtattaacaacagaacagactaagctggggaaacaatctcagagtttgaagactggctgtctcatataactcaatgagacaaaaataaagaaaaaagaatgaacaacacctctgagaaatacagaattatgtaaagaaaccaaatcgatgattcactggcatcctcaaaagagatgaggagaaggcaggcaatttggaaaacatatttcaggatagcatttattaaaacttcactacagaggccaacattcaaattcaggaaatgcagagaacccctgtgaggttatacaagaagagcatccagaagatacataatcagattccacaggctgaaatgaaagaagaatcattaagggtaactagagacaagggacaggtaacctacaaagggaatcccatcaagctaagagtggacctttcagcagaaatgctgcaagccagaagagactgggggtctatattcaggattcttaaagaaaaaatgtttaaccaataatttcatttccagtcaaactaagctccgtaagtgaaggagaaataagattcttttcagacaagaaaatgctgagggaatttgttaccaccagacctgccttacaagaaatcctgaaaggagcaataaatatgtaaaggaaagaccattaccagcccctacaaaaacacacttaagtacatagacaggtgacactaaaaagccaccacacaaataagtctgcataataaccagccaacaacacaaacacatgatcaaatccacaaaaatcaatattaatcttgaaagtaaatgggctaaatgccccaattaaaaggcacagagtggcaagctagataaaaaagcagggcctaatggtatactgtcttcaagagacccatctcacatgcaatgacatccatagcctcaaaataaagggatggagaaaacatatcaagaaaatggaaaacagaagaaagcaggggttgcagtcctaatttcagagaaaacagactttaaaccaacaaagatcaaaagagataaaaaggggattatatagtggtaatgggttcaattcaacaagaagatctaactgttttaaacatacacacaactaacacaacaacacccagattcataaggcaagtttttagaaatctatgaagagacttatattaccacacagtaatagtaggtgacttcaacacctcaatgacagtataagacagatcactgagacagaaagttatttgggacctgaactcaacacttgaccaaatggacctaacagacatctaaagaactctccaccgaaacacaatagaatatacattcttctcaacaccacatggcacacactccaaactcgaccacaccatcagacataaaacaatactcagtaaattttttaaaaaatgaaatcatacccaaccacactctcagaccacagcacaataaaaatagaaatcaatagtaagaaaattactcaaaagcatacaatgtggggggcggttccaagatggctgaataggaacagctgcagtctatagctcccagtgtgagcgacgcagaagacgaacgatttctgcatttccaattgagataccaggttcatctcactcgggattgtcggacagtgggtgcacaacagtgggtgcagcacaccgagcgtgagccgaagcagggtgaggcagtgcctcacccaggaagcacaaggggtcagggaattccctttcctagccaaggaaaggggtgacagacagcacctggaaaatcaggtcactcccaccctaatactgtgcttttccaacggtcagcaaatagcacaccaggagattatatcctgtgcctggctcagagggtcctatgctcacggagcctcactcattgctagcacagcagtctgagatcaaactgcaagggggcagcgaggctgggggagagacgcccaccactgctgaggcttgagtaggtaaacaaagcggccaagaagatcaaactgggtggagcccaccacagctcaaggaggcctgcctgcctctgtagactccacctctgggggcagggcatagccaaacgaaatgcagcagaaatctctgcagacttaaatgtctctgtctgacagctttgaagacagtagtggttctcccagcacgcagcttgagatctgagaacagacagactgcctcctcaagtcagtccctgacccccaagtagcctaactgggaggcaccccccagtaggagcagactgacacctcacatggccggctacccctctgagatgaaacatccagaggaatgatcaggcagcaacatttgctgtacaccaatattccctactctgcagcctctgctgctgatacccaggcaagcagcgtctggagtggacctccagcaaactcgaacagtcctgcagctgagggtcctgactgttagaaggaaaactaacaaacagaaaggacatccacaccaaaaccccatctgtacgtcaccatcatcaaaaaccaaaggtagataaaaccacaaagatggggaaaaaacagatcagaaaaactgaaaattctaaaaatcaaagcacctctcctcctccaaaggaatgcagctcctcaccagcaatggaacaaagctggatggagaatgactttgacgagttgggagaagaaggcttcagatgatcaaacttctctgagctaaaggaggaatttcgaagccatggcaaacaagttaaaaaccttgaaaaaagattagatgaatggctaactagaataaccaatgcagagaagtccttaaaggacctgatggagccgaaaaccacggcacaagaactatgtgatgaatgcacaagcttcagtagccgatttgatcaactggaagaaagggtatcagtgacggaagatcaaatgaatgaaatgaagcaagaagttaagtttagagaaaaaagaataaaaagaaatgaacaaagcctccaagaaatatgggactatgtgaaaagaccaaatctaggtctaattggtatactgaaagtgacgaggagaatggagccaagttggaaaacactctgcaggatgttatccaggagaaattccccaacctagcaaggcaggccaacattcaaattcaggaaatacagagaatgccacaaagatactcctcgagaagagaaactccaagacacataattgtcagaatcaccaaagttgaaatgaaggaaaaaatgttaagggcagccagagagaaaggttgggttaaccacaaagggaagcccatcagactaacagcttatctctctgaagaaactctaaggccagaagagagtgggggccaatattcaacattcttaaaggaaagaattctcaacccagaatttcatatccagccaaactaagcttcataagtgaaggagaagtaaaatactttacagacaagcaaatgctgagagattttgtcagcaccaggcctgccttacaagagctcctgaaggaagcactaaacatggaaaggaacaactggtacaagccacagcaaaaacgccaaattgtaaagaccatcgatgctaggaagaaactacatcaactaatgagcaaaataaccagctaacatcataatgacaggatcaaattcacacataacaatattaactttaaatgtaaataggctaaatgctccaattaaaagacacagactggcaaactggataaagagtcaagacccatcagtgtgctgtattcaggagacccatctcatgtgcaaagacacgtataggctcaaaataaaggaatggaggaagacctaccaagcaaatggaaaacaaaataaggcaggggttgcaatcctagtctctgataaaacagattttaaaccaacaaaaatcaaaagagacaaagaaggccattacataatggtaaagggatcaattcaacaagaacaactaactatcctaaatatatatgcacccaatacaggagcacccagattcataaagcaagtccttagacacctacaaagtgacttagactcccacattataataatgggagacattaataccccattatcaacattagacagatcaacaagacagaaagttaacaaggatatccaggaatggaactcacctctgtacaaagcagacctaatagacatctacagaactctccaccccaaatcaacagaatatacattcttctcagcaccacgccacatttttccaaaattgaccacatagttggaagtaaagcactcctcagcaaatgtaaaagaacagaaattgccaggcgcggtggctcacgcctgtaatcccagcactttgggaggccgaggcgggcggatcacgaggtcaggagatcgagaccatcccggctaaaacggtgaaaccccgtctctactaaaactacaaaaaatagccgggcgtagtggcgggcgcctgtagtcctagctacttgggaggctgaggcaggagaatggcgtgaacccgggaggcggagcttgcagtgagccgagatcccgccactgcactccagcctgggcgacagagcgagactccgtctcaaaaaaaaaaagaacagaaattataacaaactgtctctcagaccacagtgcattcaaactagaacttgggattaagaaactcactcaaaaccacacgactacatggaaactgaacaacctgctcctgaatgactactgggtacataacgaaatgaaggcagaaataaagatgttctttgaaaccagtgagaacaaagacacaacataccggaatctctgggacacatttaaagcagtgtgtagagggaaatttatagcactaaatgcccacaagagaaagcaggaaagacctaaaattgacaccctaacatcacaattaaaagaactagagaagcaagagcaaacacattcaaaagctagcagaaggcaagaaataactaaaatcagagcagaactgaaggaaatagagacacaaaaaacccttcaaaaaatcaatgaatccaggagctgtttttttaaaaagatcaacaaaattgatagaccgctagcaagactaataaagaagaaaagagagaagaatcaaatagatgcaataaaaaatgataaaggagatatcaccaccaatcccacagaaatacaaactaccatcagagaatactataaacacctctactcaaataaacttgaaagtctagaagaaatggataaattcctcgacacatacaccctcccaagactaaaccaggaagaagttgaatctctgaatagaccaataacaggttctgaaattgaggcaataattaatagcctaccaatcaaaaacgtccaggaccagatggattcacagctgaattctaccagaggtacaaggaggaactggtaccattccttctgaaactattccaatcaagagaaaaagagggaatcctccctaactcattttatgaggccagcatcatcctgataccaaaacctggcacagacacaacaaaaaaagagaattttagaccaatatccctgatgaacatcgatgcaaaaatcctcaataaaatactggcaaaccgaatccagcagcacatcaaaaaacttacccaccatgatcaagtgggcttcatccctgggatgcaaggctggttcaacatacacaaatccataaacttaatcctgcatataaacagaaccaaggaaaaaaaacacatgattatctcaatagatgcagaaaaggcctttgacaaaattcaacagcccttcatgctaaaaactctcaataaattaggtattgatgggatgtatctcaaaataataagagctattatgacaaacccacagccaatatgatactgaatgtgcaaaaactggaagcattccctttgaaaactggcacaagacagggatgccttctctcaccacgcctattcaatatagtgttagaagttctggccagggcaatcaggcaggagaaggaaataaagggtattcaattaggaaaagaggaagtcaaattgtccctgtttgcagatgacatgattgtatatctagaaaaccccattgtctcagccccaaatctccttaaactgataagcaacttcagcaaagtctcaggatacaaaatcaatgtgcaaaaatcacaagcattcttatacaccaataacagacaaacagagagccaaatcatgagtgaactcgcattcacaattgcttcaaagagaatacaatacctaggaatccaacttacaaaggatgtgaaggacctcttcaaggagaactacaaaccactactcaatgaaataaaagaggatacgaacaaatggaagaaaattccatactcatgggtaggaagaatcagtattgtgaaaatggccatactgcccaaggtaatttatagattcaatgccatccctatcaagctaccaatgactttcttcacagaattggaaaaaactactttaaagttcatatggaaccaaaaaaaaaagcctgcattgccaagtcaatcctaagtcaaaagaacaaagctggaggcatcatgctacctgacttcaaactatactacaaggctacagtaacaaaaacagcatggtactggtaccaaaacagagatatagaccaatggaacagaacagaggcctcagaaataccaccacacatctacagccatctgatctttgacaaacctgacaaaaacaagcactggggaaaggattccctatttaataaatggtgctgggaaaactggctagccatatgtagaaagctgaaactggatcccttccttacagcttatacataaattaactcaagatggattaaagacttaaatgttagacctaaaaccagaaaaaccctagaagaaaacctaggcaataccagtcaggacataggcatgggcaaggacttcatgtctaaaacaccaaaagcaatggcaacaaaagccaaaattgataaatgggatctaattaaactaaacagcttctccacagcaaaagaaactaccatcagagtgaacaggcaacctacagaatgggagaaaatttttgcaatctactcatctgacaaagggctaatatccagaatctacaaagaactcaaacaaatttataagaaaaaaacaaccccatcaacaagtgggtgaaggatacgaacatacacttctcaaaagaagacatttatgcagccaacagacacatgaagaaatgctcatcatcactggtcatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcaattcctcaaggatctagaactagaaataccatttgacccagccatcccattactgggtatatacccaaaggattataaatcatgctgttataaagacacatgcacacatatgtatactgtggcactattcacaatagcaaagacttggaaccaacccaaatgtccaacaatgatagactggactaacaaaatgtggcacatatacaccatggaatgctacgcagccataaaaaaggatgagttcatgtcctttgtagggacatggatgaagctggaaaccatcattctcagcaaactatcacaaggacaaaaaaacaaacactgcatgttctcactcataggtgggaattgaacaatgagaacacatggacacaggaaggggaacatcacacagtggggcctgttgtggggtggggggaggggggagggatagcattaggagatatacctaatgtaaatgacgagttaatgggtgcagcacaccaatatggcacatgtatacatatgtaacaaacctgcacgttgtgcacatgtattctaaaacttaaagtataataaaaaataaaaataaaaaaataaaaaataaaaaaaagcatacaatgacatggaaattaagcaacctgcccctgaatgacttttaagtaaataataaaattaaagaagaaatcaagaaattctttgaaactaatgaggacaaagataaaacataccagaatctctgggacataactaaagcagtgtcaagaggaaagtttatagcactaaaagcccacatcaaaaagttagaaagatctcaaattaacaatctaacatcagaactagaagaactagaggagcaagagcaagctcaccccaaaactaacagaaaacaggaaacaaccaaaatcagagctgaactgaagaagattgagaagcaaaaaaaaaaaaaacgtattaaaaaaagagattaatgaatttaagagttggttctttgaaaaaataagacagagaaaccacgagctagactaaaaaattttaaaaaagattcaaataaacacaattagaaatgacaaaagggacattaccactgacctcacagaaatacaaaaaaaaaaatcagggactactatgaatatatgcagacaaactagaaaatctagaagaaacagataaattcctggacacatacaacttcccaaagctgaaccaggaagaaattgaatccctgaacagaccaataacaagttctgaaattgaatctgtaataaaagcctactaaccaagaaaagcccagaaccagttggattcacagtagatttctactagatgtataaggaagagctagtaccattcctactgaaactattccaaaaaaaattgaggagggagaactcctccctaactcactctatgaggccagaatggcagaaacacaacaaaaaaagaaagcttcaggccaacttccttgatgaacacagatgcaaaaatcttcaacaaaatactagcaaaccaaatccagtagcacatcaaaaaggtaatcgacaacgatctagtagcctttttccctgggatacatggttgattcaacatatgcaaatcaataaatgtgattcatcacataaacagaactaaaaataaaaactgtgattatctcagaaaagactttcagtagaatttaacatccattcatgttataagctcttaataaactaggcatcaaaggaacacacttcaatataataagagtcatctatgagtaagccacagccaacatactgagtgggcaggaaacattctccttgaaaaccagaacgagacaaggataccctctcttaccactcctattcaatacagtattggaagtgctggccagagcaatcaggcaagagaaagaaaaggcatccagagagaaagagagtatgtcaaagtatccctgcttacagaaaacatgattctatctctagaaaaccccatagtttctgcccataatctccttgatctgataaacaacttcagcaaagtttcaggatacaaacttaatgtacaaaaatcagtagcattcctatacaccaagatccaaaccaagagccaaatcacaaatgaaactgcattcacaattgccacaaaaaataaaatacctaggaatacacctaaccaggcaggtgaaaggcctctacaacaagaattacaaaacactgctcaaagaaatcagcaaaaacacaagcaaatggaaaaacattacatacttatggacaggaagaatcaatatcactaaaatggccattctgcccaagacaatttacagattcaatgctatttctatcaaatgactgatgacattcttcacagaactagaaaaactattaatattttaaaattcatatagaacaaaaaaagcccaaatagcaaaggcaatcctaagcaaaaataagaaaactggaggcatcatgttacccaacttcaaagtatactacagggtactggtaaccaaacagcatggtacttgtacaaaaatagacacatagaccaaaggaagtgaacagagaacccagaaataatgctgcacacctatgaccatctgatcttcgacaaaccttacaaaaataagcaatagagaaagcatttcccatttaataaatggtactgggataaatggctaggtatatatgcagagattgaaactggacctctttcttttgcatccaaaaaataacaaatgtatactttaatttctaaaataggtgtcttgacatgtgcacaactgtattttcctagtgcaaactttcccattgattattataatttttaaaaattatactttaagtactagggtacatgtgcacaatgtgcaggttacatagatatatgtttcatgttggtgtgctgcacccatcaactcgtcatttacattaggtatttatcctaatgctatccctcccccagccacacaccccacaacaggccccagtgtgtgatgttccccgccctgtgtccatgtgctctcattgttcaactcccacttatgagtgagaacatgtggtgtttggttttctgtccttgtgatagtttgctgagaatgatggtttgcagcttcatccatgtctctgcaaaggacatgaactcatccttttttatggctgcatagtattccgtggtgtatatgtgccacattttcttaatccagtctatcattgatcagcatgtgggctggttccaagtctttgctattgtgaagagtgctgcaataaacatacatgtgtctttataacagcatgatttataatcctttgggtatatacccagtaatggaatggccgggtcaaatggtatttctagttctagatccttgaggaatcgccacactgtcttccacatcagttgaactaatttacactcccaccaacagtgtaaaactattcctatttctccacatcctctccagcacctattgtttcctgactttttaatgatcgccattctaactggtgtgagatggtatctcattgtggttttgatatgcatttctctgatgaccagtgatgatgagcattttttcatatgtctgtgggctgcataaacgttttcttttgagaagtgtccattcatatcctttgcccattttttgatggggttgtttttctcttgtaaatgtgagttctttgtagattctggatattagccctttgtcagatggataggttgcaaaaattttctcctattctgtaggttgcctgttcactctgatggtagtttcttttgctgtggagaagctgtttagtttaattagatcccatttgtcaattttggcttttgttgccattgcttttggtgttttagtcatgaagtctttgcccatgcctatgtcctgaatggtattgcctaggttttcttctagggtttttctggttttaagtcttacatttaagtctttaacctatcttgacttaattttcatataagctgtaaggaagggatccagtttcagctttctacatgtggctagccagttttcccagcaccatttattaaatagggaatcctttccccagtgcttgtttttgtcaggtttgtcaaagatcagatggctgtagatgtgtggtggtatttctgaggcctctgttctgttccattggtctatatctctgttttggtgccagtaccatgctgtttttgttactgtagccttgtagtatagtttgaagtcagatagtgtgatgccctggctttgttctttttgcataggattgtcttggctatgtgggctcttttttggttccatatgaactttaaaatagatttttccaattctgtgaacaaagtcattggtagcttgatagggatgacattgaatgtataaattaccttgggcagtatggccattttcatgatactgattcttcccatccaggagcatggaatgttcttcaatttgtttgtgtccccttttacttcatagagcagtggtttgtagttctccttcaaaaggtccttcacatcccttataagatggattcctaggtattttattctttttgtagtaattgtgaatgcgagttcactcacgatttggctctctgtttgtctgttattggtgtataagaatgcttgtgatttttgcacattgattttgtatcctgagactttgctcaagttgcttattagcttaaggagatttggggctgagacaatggggttttctaaatatacaatcatattatctgcaaacggagacaatttgatttccttttttcctaactgagtaccctttatttctttctcttgcctgattgccctggccagaacttccaacgctatgttgaataggagtggtgagagagggcatccttgccttgtgtcagttttcaaagggaatgcttccagtttttgcccattcagtatggtactggctgtgggtttgtcataatagctcttattattttgagatatgttgcatcaatacctagtttattggcagtttttagtatgaagggctgttgaattttgtagaaggccttttctgcatctattgagataatcatgtggtttttttccttggttctgcctatgtgatggattacatttattgatttgtgtatgttgaaccagccttgcatcccagggatgaagccaacttgatcatggtggataagctttttgatgtgctgctggattccttttgccagtattttattgagcatttttgcattgatgttcatcagggataatggcctaaaattctcttttttgttttgtttctgccaggctttggtatcaggatgatgctggcctcataaaatgagttaggaaggattctctctttttctgttgtttggaatagtttcagaaagaatggtaccagcttctctttgtacctctggtagatttcggctgtgaatccatctggtcctggaattttttttatttgtaggctattaattattgcctcaatttcagaacctgttattggtctattcagagattcaacttcttcctggtttagtcttgggagggtatatgtgtgcaggaatttatccatttcttctagattttctagtttatttgcaaagaaatgtttatagtattctctgacggcagtttgtatttctgtggggtcagtggtgatatcccctttatcattttttattgcatctatttgattcttctctcatttcttctttgttagtcttggtagcagtctattttgttgatcttttcaaaaaaccagattcattgatttttttgaagggtttttcatgtctcttcagttctgctctgatcttagttggttcttgccttctgctagcttttgaatttgttttctcttgcttctctagttcctttaattgtgatgttagggtgtcaattttagatctttcctgctttctcttgtgggcatttagtgctataaatatccctctacacactgctttaaatgtgtcccagagattctggtatgttgtgtctttgttctcacgggtttcaaagaacatctttatttctgccttcatttcattatttacccagtagtcattcaggagcaggttgttctgtttgcatgtacttgaacggttttgagtgagtttcttaatcctgcgttctaatttgattgcactgtggtctgagagacagtttgttgtgatttctgttcttttgcatttgctgaggagtgctttacttctaactatgtggtcaattttagaataagtgcgatgtggtgctgagatgaatgtatattctgttgatttgggatggagagttctgtagatgtttattaggtctgcttggtacagagctgagttcaagtcctggatatccttgttaaccttctgtcttgttgatctgtctaatattgacagtggggtgttaaagtctcccattattattgtgtgggagtctaagtctctttgtaggtctctaaggacttgctttatgaatctgggtgctcctgtattggatacatatatatttaggatagttcactcttcttgttgaattgatccctttaccataatgtaatggcctcctttgtctcttttgatctttgttggtttaaagtctgttttatcagagactaggattgcaacccctgctttatttgctttccatttgcttggttgatcttcctcattccctttattttgagcctatgtgtgtctttgcacatgagatgggtctccggaatacagcactctgatgggtcttgactctttatccaatttgccagtatatgtcttttaattgggggcatttagcccatttacatttaaggttaatattgttatgtgtgaatttgatcttgtcattatgatgttagctggttattttgcccattaattgatccagtttcttcatagtgtcaatggtcttcacaatttggtatgtttttgcagtgtctggtactggttgttcatttccacgtttagtgcttccttcaggagctcttgtaaggcaggtctggtgctgacaaaatctctcagtatttgcttgtctgtaaaggattttatttctccttcactatgaagcttagtttggctggatatgaaattctgggttgaaaattctttctttcagaatgttgaatattggcccccactctcttctggcttgtagagtttcttcagagagatctgctgttagtctgatgggcttccctttgtgggtaacccgacctttctctctggctgcccttaacattttttccttcatttcaaccttggtgaatctgacaattgtgtgccttcaggttgctctactcaagaaatatctttctggtgttctctgtatttcctaaacttgaatgttggcttgtcttgctaggttggggaatttctcctggataataccctgaagagtgttttctaatttggatccattctccccatcactttcaggaagaccaatcaaacatagatttggtcttttcatatagtcccatatttcttggaggctttgttcatttcttttcactcctttttctctaatcttgtcttgtcactttatttcattaatttgatcttcaattactgatatcctttcttctacttgatcgagtcagctactgaagcttgtgcatgcgtcacgaagttcttgtgctgtggttttcagctccagcaggtcatttaaggtcttctccacattgtttattctagttagccatttgtctaaccttttttcaaggtttttaacttccttgctataggttggaacatgctcctttagcttggagaagtttgttattaccaaccttctgaagcctacttctgtcaactcatcaatctcattctctatccagttttgttcctttgctgaccagtagctgtgatcctttggaggagaagaggcactctggtttttggaattttcagcttttctgctctggtttctccccatctttgtggtttcatctacctttggtctttgatgatggtgacctacagatggggttttggtgtagatgtgctttttgttgatgctgatgctattcctttctgtttgttagttttccttctaacagtcgggcccctcagctgcaggtctgttggagttagctggaggtccactccagaccctgtttgcctgggtgtcaccagcagaggatgcagaacagcaaatatttctgcctggtccttcctctggaagcttcatcccagaggggcacctgcctgtgtgaggtgtctgtcagcctctactgggaggtgtctcccagtcaggctacatgggggtcagggatctacttgaggaggcagtctgtccattctcagagctcaaatcccatgctgggagaaccactgctctcttcagagctgtcagacagggacgtttaggtctgccgaagctgtctgctgccttttgttctgatatgccctgcccacagagatggagtctacagcaaggcagtaggtcttgctgagctgtggtgggctccacccagtttgagcttcctggcctctttgtttacactgtgagcacaaaaccgcctactcaagcctcagcaatggtggatgcccctccccccgccaagcagcagcattgcaggttgatgtcatactgctgcgctagcagtgagcaaggcaccgtggggctgggacccaccgagccaggcacaggagggaatttcctggtctgccggttgtgaagactgtgggaaaagcatagtatttggacaggagtgtaccattcctccaggtacagactgtcacagcttcccttggctaggaaagggtaataccctgaccccttgcacttcctgggtgaggtgacacactgccctgcttcagctcgccctccatgggctgcacccactgtccaaccagtcccaatgagatgaaccaggtacctcagttggaaatgcagaaatcacccttcttctgtgttgatctcgctgggaactgcagaccagagctgttgctatatggccatcttggaactctgaaatggacctctttcttacaccacatacaaaaataaactcaagatggattaaagacttaaatgtaaaacctaaaactataaaaacccaggaagataacctaggaaataccattctgaatataggacttggcaaagatttcatgacaaagatgctgaaagaaattataacaaaaacaaaaattgatgaatgggttctaattaacctaaagagattcttcactgcaaaagaaactatgaattgagtaaagaaacaacctatagaatgggagaaaatgtttgcaaactatgcaaacaggtgatggcatcttagactcaacaaaatacacaagcatgtgtaaatccattttaatccacaacctgggagtagggagttaatattgtacatgcctcaatcaagaatctaccctcttggagcaattccttagtatttgaaagatcctttcagaagtcgacaacctagaactattcaaccaagagctattcaactattacactctgaatcagagagtttgttttgctagaaataattttttgttagtaaaatgaatggtttcaaggtatctgaattggctagaaatattttccaggcacctgtgctcaggcatggccagggcacaaaagtctcactagcagtctaacaccaggcctatgatgacattaagtctttggattccacagaattgctaagaattctgctgcgtgctttaactttcaaagaggctacggacagagagtggaaacttcgctgggctcccaagacaggttttctgcttccttattaaacaaagctttttggcaatgaggtgggcagaattcattctaagacttgctttctttgtcaacacttggtaataaggtgatggaggatgagaaggaaagccctcacctacctctgctcttgggaggcaatctatatctcccaaaatcactggacaagtgtgaaggccaaactgacccatctgcagctggaagcctgcccagttcctgacctccggtcaccaccgtcaccaaagtcacttctattagccacccagggtacaactgattcaagaactgtaactcaagtcatgaacctctgcaatcatgaaaacctctcttcttcgcacaaatatatgaataaaatgacattggcacaagttcagcttgtagaaattcatttaatgttgcctcaggtaattagtttatttggtctgtcaaagtgacccaaagcttatccatttggagtctctgttatgaacagacatatagtagttgctaagcaacatcatgcattgttgtttcctcatccaatttaaaattttcaattcacagtaaaggtcttcagagaaaagttattgtgcagggtgggccaaataccatttttcactgtagcccattcaatttagaaaagaaattacagcgtaccatttaatcaacataaaatgatttgtacagaacatttaacatcttcttgaaatgcagctgtcttcttttactaatcagatctacttaatttattttaaactttcccaaggagattttttctccttcaatccttgacccttcctccattccctcaactttcaagccaatttgcagatacccgttagcatgggaactgggagacgtgggaaggaagatttggaaatataagatatactcttcttatcttgtagtttagtcatgggaaaggagtctcaagtagttgagtcattctaatgagtcacttacatgaaattccaactttattataaagaagacttatttaacatagtagtttctggccaggcatgatggctcctgcctgtaatcttagcactttgggaggtcaactggaggattgcttgaacccgggagttcaagaccagcctgggcaacatagggagaccctgtctctacaaatatatttttttaattagctgggcatggtggcaggctctagtggtcccagctacttgggaggctgaggtgggaggattgccttagtccaggagatcgaagctgcagtgacctatgattgcaccacggcactccagcttgggtgacagagtgagattccatctcaaaaaaacaaacaaacaaacaaaaatagtagttttctgatatgaatgctgcaaaattaatcaattgtttgctctaataatacctggtattaccttcaagtatcttgaaaaagtgtctctgaggttccctcccaaaggatagaatgtcacattttttcatttcgccagtaatatttcttggcattaagattaactttttggcaaaactccttggcaaggaaatacgttttcacaaaatacacaaagccatttctgcatagtgaccctctcattgcatgttgagtgtattgaaacatcaagtgaatcaaaatggattaaaatacactcttgattatcacaatttcttggaatgtggaacaatctagaattgaaaccttgcaaatttaggctaatggaagaaaagaactatgaacatgaataaatggacaaaataagtggaatattttaaaggaaatataattttgttaccataacaatatggagaaaatctgattatctcagcagtaaaatagctcctaggacaagattgatttttattggcttaaaacattattaagtttcttggtttgtgtgtatatggtgggaggatattccccaggtaatatgtttaaattacaatagaagagggaaccaataagttactgggggttggggggaggtcagtttattcttgactttaggatttgttttcattatagaggctttcattttaggggacagagtatgggaacaggtagacacatgagaaaagaaactttagagaaacagtccagggatttaactgagggggtttactaaagtttgctgtaggtatggccccacactctcctccctagtgatgcagctgagcatgctgtttaaggaaccaaaaatacctgggttcaattctcagctgtgctgtcataaacctatgatcttggactaatcacatatacctttctgtacctcaacattcccatttgtaaaataggaatgaggatggtaatacctcaaaatgtagttatgcagattaatgggttaatccacaacagatccagcttcctgggcttatgatctctgcagtcccacagggcctcgtgcttagtatggtctccttcttggtttaatgctctgctgtcatcttgaaattcctaatcagtttagaacaagcaagaaaactttgacctgggccccacaaattctgtagcatgcccctagatacataaaatattcagaacaaatcctggcccatcatcagtgccagatgttgtctttattctccttctcccaccagaatttttgttttacttcccagtattcagatctaatagtgatgctaaaatttagggggtaaaaggagagcaggaggttgatagaggagccagtctgctgcacaaagtactcacttctgcagtatcccaccaatgaatgaggcaggataaaaacaggggctacccaaggggatccagaaaatctgggttattttacttgcaagtttggatagaaactacataggctggtaaaacatgcattgatggagaagtcttcatgaatcaaatttagtgagtagctaatagtatgtcagctattatttaaatcaattatttacatgtaaacaagtactttaaaagtacaagacaacatctggttccaaaatggcagcatagaaacaagctggcttcacttctccacaccccgacagaaaaccaaaaaccaaatgtatagcatcaagattatcaccaacaatattccagaactcaaatgcaaggagacagttcctggggtcacagagaagtgaataaactccaagaagacagtaagagaatcagactttcagcctcttgccgcagtttatccagcaccaaatgtgtggaataattccccacaactcagagtttctacactggaaaaagtgaaatcaaggtagaaaaccaccttccgcaccatcttgggttccctgggaggagacttgtccctgccccaacccacagaagcactggagtatctgaaaggagaaatgtccctgaggacagccagagacaaatgggggagccctgaaaactctgctctgtagataggccaaatcagaatggctgttgagcagcaccacaacgtaggggatttgttctatgagtccctcaggcaggaacccctacccaaccttcccatgctgccagaatatctgagacctcccccacctaagatgggtggaactctgattcttttctaggactgaggcaaacctgggcttaaccaccatctagtgttgaaaatgaggcagtaacatagtgggggtggtgggagagagaaaatctgcaggaaaattaaaaagaaactctaaacacatccaacaaaaaaatagtacaagccagacaaagaagattagaatgaataactattcaatccaaaggcacagatgtacatccaaaaggagcaagagaaaaagagaaccatgacttccccaaaaggacaaagcaaggtacaagtgactgaccctaacaagacaatgaaacataagctttctgaccaaaaattcaaaatagcacttttaaagaaatttggtgatctctaagataacacagaaaggcagttcagaagtctatcagagaaatttaacaatgagattaaaataattttttaaaaatcaaacaaatcttggaactgagagacacattggctgaaatgaacaatttattaaagtctctcaacagcaggattcgtcaaggaaaagaaagaatcaatgaacttaaagacaggctatttgaaaatatatagagaagaaatttaaaaaaaagaatgaaaagaaacaaagatcacctaaacatatagaacattacctcaaaagaccaaatctaaaaattattggtattcaagagcaagttgagtaggatccaaaggtagaaagtttactcaaagaaataataacaagaaactttccaaaacttgaaaaagagatacatatgaggcacagaaaggtcagagaacatcaaacagatttgacccaagtgaaactaccctaaggcatataataaacaaactctcaaaggtcaaggacatatagaagatctcaaaagcagcaagataaaaagcaaataacctaaagaaactccaatgcatctagcaacagacttcacaacagaaaccaaacaggccacaagggactcggatgacattttcaaagtgatattaaaaaaaaaaaataagaacactatcatctgagaataccatatccagcaaagctatacttcaaatatgaaggagatggaaagtcttttccagacaaacaaaagctgagagaattcactaccaccagaaccattttacaagaaacactaaagggatttctgcaattggagagaaaaaaaaaaacccactaacatgcagaaagaaaacatttgaaggtataaaacccactggtattaagtacatggacaaacccagactaatgcaatactgtaattgtggtgtgtaacccactcatattctagtatgaagacaaaaagacaaacctatcaaaaatagtgatagcaacagcaatgtgttaagagataggtaatataaaaatatgtaaattaagtcaaaatataggggtgggatggagttaaagtgtagagtttatttttctcattgtttgtttatttctattattttctttgtgatctaagtaaagttaccaactttttaaaataacttgttttatctataagatgtttttgtaagcctcatggtaaccacaatgcaaaaacctatggtatattcactaaaaatgaaaagcaatgaattaaaacatactttcggagaaaaatcacataactacaaatgaaaacagtaagaaaggaagagagaagttacaaaacaaccagaaaacaagcaataaaattgcattactaagtcttcacttatgaataataacactaaatattaatggactcaattctccaattaaaagacacaaagtggcagaatggataaagaaacaagacccaactatatgttacctacaataaacacattttacctattaagacacacaaacactgaaggggaaaggatgaaaaacatattccatgtaagtggaaacaaaaaaatagcaggagtagctatacttagataaaatagactacaaatcaaacgtaaaaagagacaaggtcattatataatgaaagacgtcagttcagtaagaggatataacaactttaaatatttctgcatccaacaccaaagcactcaagtatataaagcacatattaatatctaaagggagagagaaactgcaatacaataatagtaggggacgttaacatcccactctcagtaacgggcagatcatccacacacagaaagtgaacaaagaaatattggagttaaaccacacactaaaccaaataggcctaactgacatttacagaacattttacccacctacagcagaatacacatacttttcattagcacatgacacattcttcaaaatagaccatatcttaggccataaaacaagtctcaacaaattcaagcatgggaagatgggcggggggtgagggatgagaaattacttaaaggatgcaatgtgtaatatttgggcaatggctattctaaaagcccagaattcatcactatgcaatatacccatgtcacaaaatgacccttgtaccccctaaacctatagaaagaaaattttttgaaaaaaaatcaagaaagtagaaatcacattaagtatcttttctggggacaatggaataaaactagaaatcaataacaagaggaacattggaaactacacaaatgcatagaaacacatagaaattcaacaacatgatcatgaacaacaaataggtaaatgaagaaattaagaaggaaattttaaaatttgtatgaaacaaatgtaaatacatttgtgttgaaacaaatgcaaatggaaatacaacataccaaattctacaggatacagaaaaagtggtactaagagggaagtttatagcagtaaacacctatatcaaaaggcagacagacttcaaatggataacttaataaggtacctcaaggaacttgaaaaacaaaaagcaaaccaaatccaaaattagaaaaaaatgaaataacaagaatcggagcaaaaataaatgaaattaagactaaaaaaaatacagatcaacaaaatgaaaagttgattttttaaaagataaatgaaattaaagcttttgctagactaaaaaaaagagagaaaacccaaataaataaaatcagaaaaagatgtaacaaatgagaccacagaaatacaaagaatcattagaaactattatgaaaaactatacaccaaaaaaattgaaaaacctagaagaaatggacaaatttttgaacacatataagcaacaagatagaaccatgaagaaacagaaaacaattagactattatttactatagtcaacctgttgtgccatcaaatagtaggtcttattcattctttccaacttttttttacacatcccacctcacctcacccccattccccaactaaccttcccagcctctggcaaacatccttctactctctatgtccatgagtttaattgctttgatttttaggtcccataaataattgagaacatgtgatgtttgtctttctatgcctggcttatttcacttaacataacgatctctggttccatccatattgttgcaaatgactgaatctcattcttttttatggctgaatagtactccattgtgtatatgtaacaaattttctttattcattcatctgttgatggacacttacgttgcttccaaatcttagctattgtgaacagtcctgcaataaacataggagtgcagatgtatctttgatatactgatttcctctcctttggatataaacccagcagtgggattgctggggccatatggtagctttattttagttttttgaggaacctccaaactgttctccataatagttgtactaattaatattcccaccaacagtgtacaaggattccctttttccacatcctcatcaatatttattgtcttttgaacatgaaccattttaactgggatgagatggtatctcattgtaactttggtttgcatttctctgatgatcaatgatgttgcgcaccttttcatatgcccgttttccatttgtatgtcttattttgaaaaatgtctattcaaatcttttgcccatttttttgatcagattgttaggttttttttcttacagagttgttagagcgccatatatattctggttattaataccttgtcagaagtgggggtagtttgcaaatattttctcccattctctgggttttctcttcactttgttgattgtttattttgctgtgcagaagctttttaacttaatgtgatcccatttgtccatgtttgctttagttgcctgtgcttgtagggtattactcaaaaaatttttacccagaatggtatcctggagattttccccagtgtttttttgtagtagttttatagattgatgtcttggatttaagtttttaatccactttgatttttgtatatggcaagagatggagtctagtttcattcttctgtatgtggatatctagttttcccagaaccatttatttaagagactgtctttctccagtgtatgttcttatataacggttgtcgacaatgagttcactgcacatgtgtgcatttatttctgggttctctactctgttccattggtctctgtgtctgtgtttatgccaatgccatgctgttttggctactatagctctgtaatataatgtgaggtcagataatgtgattcttccggttttgttctttttgcttaggatagctttggtgattctgggtcttttatggttccatataaattttaaaatttttatttgtgtgaataatgtcattgatattttgatagggattgcattaaatctgtaaattgctttggggaatatggacattttaacaatattgatttttccaatccatgaacatgtaatatttttccatttttgggtattctcttcaatttctttcaaaagtattttatagtttttattacagagttttttttacttctgtggttaattcctaggtatttaattatgtttgtggctattgtaaatgagattacttttttgtttctttttcagattattcactattggcacatagaaatgctactgacttttttttgtatgttgattttgtatcctgcaactttgctgaatttgtttatcagttctaatagttttttggtggagtccttagtttcttccaaatataagattatatcacctgcaaacaaggataatttgacttcttcctttccaatttagatgccgtctatttctttctcttgtctgattgctctagctaggacttctagtactacgttgaataacactggtggaaatgggcttccttgttgtgtactagatcttagaggaaaggctttcagtttttcctcattcagtatgatactaactgtcgggttgttgtatatggcctttggttatgttgaggtatgttccttctatacccaggtttctgagtgttttttacatgaagagatgttgaattttaccaaatgctttttcagcattaattaaaatgatcatttgttttttgtcctacattctattgatataatgtatcatgttgatttatttccatatgttgaaccatccttgcatcccaggaacaaatcctacttggtcatgatgaatgatctttttaatgtgttgttgaatttggtttgctagcattttgttgaggatttctgcatcaaaatttattagagatattgacctgtacttttcttttcttgatttgtcttgtttgagcatcagggtaatactggccttgtagaattagtttgaaagtattccctccgcctctattttttggaatactttgagcaggattggtattagttctttaaatgtttggtagaattaagcagggaagccctggggtcctgggcttttctttactgggagacattttattctgactgcagtctcatgacttgttattgaactgttcaggttttggatttcttcctggttcaatcttggtagattgtatatatctaggaatttgtccatttcttctagattttcaaatttattggcatatagctgctcatagtagccactaatgatcctttgaatttctctggtatcagtcataatgtctcctttttcatctctgatttatttcaatcttttttcttagtccagctaaaagtttgtcaattttaacttttcaaaaatccaactttttgtttcactgatgttttgtattgtttccttcattttaaattaattttatttctgctctgatctttattatttcttctactaattttgggtttcgtttcctcttgcttttctagttcttccagatgcatccttaggttatctatctgaagtttttcttcttttttgatgtaggcacttatactatgaactttcctgttagtaccacttttgccatatccacatgttctgttagtcgttggatgaaatgttctgtaaatattaattagatccatttgatctataatgcagagtaagtctgatgtttccttattgattttctgtctggaagatttgtcaaatgctgaaactggggtgttacagtctccagctgttattgcattgggggtcatctctttctttatctctaataatattttctttaaatatctgggttctcccatgttaggtgcatatatgtttaaaattgttatatcctcttgttgagttgaccgctttatcatcctatagtgaccctctttgtctcttcttatggttttttgtcttgaaacttattttttctgatacaagtataggtactcctgctttttgatttccattgacattgaatatctttctatccctttatttttagtctgtctttatacatgaagtgcatttcttgtagacaacaaatcaaatgggcttgttttatccatttggcctttgtatgtctttttggttggagagattagttcatttacattcagtgttattattgataagtaaggagttactcttgttattttgttatttgttttctggttgttttgtggtcttctcttccttttttttcctccatcttccttttagtgaaggtgattttctctgatggtatgatttagtttcttgctttttattttttgtgtatccattgtattttttttttttttttttggtttgtgattaccatgaggcttgcaaattctatctaaaaacccattgttttaagctgataacaacactgttggcataaacaaaaagaaaaccaataaaagctctacaccttaattttcttcccctgctttttaattttctgttgtttctatttatatcttattgtactgtctgtcttgaaaagttgtagttatttttggttggttcatcatttagtctttctacttgggataagagtagtttacacaacacagttacagtgttataatattctgtgtctttctgtgtatttactattagcagtgagttgtgtgccttcattcggtgattacttactgctcattaacatccttttcttgccgactgaagtactccctttagcacttcttgtaggacagatgaaacccctcagcttttgcatggaaaagtatttctttctccttcatgtttgaaggatattttcactggacatactattctagggtaaaaggttttttccttcttcagcactttaaatacttcatgtcactctctcctggcctgtaaaaagtcagatgctggaagtactggacctccactgtatgctatttctttctttttttaatgctgcttttaggatcgtttctttatccttgacctttgagaatttgattattaaatgccttgaggtagtcttctttgggttaagtctgcttagtgttctatgacaccaaaccttaggtatctaggtttgggaagttctctgttattattattttttaatacactttctacccctatctctttctctactccttctttaggaccaataactcttagatttgcccttttgaagctattttctagatcctgtaggtgtgctttatatttttttccttttgtctcttctgtgtattttcaaatagttcactatttgcaaataatagaattagtctttaagctcactgattctttcttctgcttagtcaattctgctattaaaggactctgatatattcttcaacatgtcaactgcatttttcagctccagaatttctgcttgattctttttaattatttcaatctctttggtaaatgtatctgataatttctaaatttcttctgttatcttgaatttgagtttcctcaaaacagctattttgaattctctgtctgaaaggtcacatatctttgtttctccaggattgttccctggtgatttatttagtttatttggtgaggtcatgtttttctgggttgccttgatacttgatgttcatctgtgtctgggcattaaagagttaggtattaattgtaatcgtcacagtctgggcttgttttcacctgtcattcttggtaagacttttcagatagtctaaaggacttgggtgttatgatctaagctatatctgctttagggggtacctcaagcccagtaacactgtggttcttgcagacccattgaggtaccaccttgatggtcttgaacaagatccggtagaatctgcctggattaccaggcaaagacttgttcttttctcttagtttctcccaaacaaacagaggctttctctctgttctgagccacgtgaagcttggcatagagtgacactagcacccctgtggccaccaccattaggactgcactgagttttgcccaagacctgtaaccactccctggctactgcctaggttctgccaaggccctggggctctgcaatcagcaggtgccaaagtcacccaggcctgtgtccttcttttcaggatggcaagttcccctcaagctccagacaggtccagaggggctatccaggagccagggaccagagtcaaaaaccttagaaatctatcaagcgttctattgtgctgcagctgagctggcactcaaaccacaagatgcagtccttcctactctttcctcctctttccaaaagcagaggagccttgccccactgtggtggccattgccacccctggcaacaaggagtactgccagactactgccaatgttcccataaggccccaaggctctttagtcagcccgtggtgaatgctgcctagcctgggactcacctttcagggcactgggcttccctctgacccagagcaggtccagaaatgccatccaatagtcaagtcctagaatcagggagtccaagagcctgcttgctgctctaagcacctgtggctgagctggtacctaaggtgcaagacaaagtcccctttacttttccctctgcttttctcaagcagaaggagtcttgccctatagctcccccaactggtaatgtactgagtctcacctgaagccagcaagtccaaggctcacccaaggccctcaacatagtacctgggtatggctgttggttatccagggcccaaaggctcttcagttagcaggtgatgaatactgcaaggactgagttcttctcttcaaggcagtgggttccctcctggcccagagtgtgtctagaaatgttgtccagtagctagggcctggaaaaggggcctcatgactctgcctggtaccctattctgctctagctgagctggtatccaagatgcaagacaaagtcctccccactcttccctctcctcccctcaagcaaaatgaaggggtctcttttcgagtgggtgagctgtgcagccagcagttaggggaggggtgatgccagcacttccttagccaccccagctgttgtctcagtagcttatgtgtccccccaggccactggctctgggcccaggactcacctagaagttgcagtccctgtggcctacactgcctttcaagcttatctggggccccagagtattttagctcatggtggtgtggcttgcaagaacccaagttctgactgctgggatcagtgattcctctgtggctagggctggtttaaatgttccatcagtgggcagatgtcagctgagtttgttccggttttcctctttgctgtaacaggacagcactaagtccaatgcctcacaattgctgcaccctccctcccccagtgcacagaaatgctttccacacctcacctcactgctagatggtgggggatgggggatgtcagcaattcaagactgttttttctgtctcttcagtgcctctttcagcaatatgaagttaaaacaaggtactgtgagtgcttacctgatttttggttcttatgaggtttttttttttgtgcgtagatagttgttaaattgttgtccttgtgggagggaatgatccatggagtcttctattctgctatattattccacccctctccccactaagtattctgaatatcaggtgtatcctatcattcacagggaaagagaaccatggaggcccacgtgcttttatgtctaaataggtacacgttattcatgaatcaggcaaactcctaaataatcttttcttatactactttggcaaatatagcttcaaatgactcagaaggccaaacttcaagtttaaggattctttaagctctcaaaattgctcatgtgccagcctatgtatgaccactcccgcctctcatccaagcttcaatcactgcttctatctataaacagccaaacttgagccaccctcagggctgggggacacatgcaccagaggtacaggtaccctctacaggacaaatctgagaaagacatctatacagggcttggaagaaaatctgtgtggacagggaataccagggccttggatacctagaatgagatcaagaaagtcaggtagggggtaaaggtgagaaccgcctttttgttcacagactgctcacctggtgcagaggagcatggttggaatggggttacaacaggggctctctaagtataggatgaacatcatccctgaaatcttggttaccctttgagtctgtattctgaagggtcaacttaaattaaattttgcttcatctacatattactatacagttataaattccaaattatagttggctttgtgtatacaggcatctaaattttctagactcaaatttatacccccaactgtgctcccaattaccccctccaactcctacccagccatcctccaattctttccaaatattcccagccagcaatcttcaatgccactcctaacatgctcgacagcactgtctccctcaaacccctcagtaaacatttcagatgagctgttcatttactctcttttcagtgatgagatcatggcacattttccaggaacaaatgggttaatttatattgctgtactactacctaaaatgaaaatattagaaacctatctattataaatatgaaggtcacgacaaaaaagagagagagggatgtcatcatagcaaatggagctcatgagtattctaaatatagccttagtcaggacttgtactaagagtctagggaccttttagaaaatcatttttctcgtgttgctgccctttgtatctgacaaatattgatttcagttatgttttgaataacaatgaaaacagtgccttagatagaactttagtcataaactatttaacaccttagaaagttgaaagaactctggacttacagttctgaggctgggtagtatctttttagcagctggatgtacctcaggcaagctcctcaatctctctttcctacattgtaaagagtcatagaattttggagtggaagacacctttcagataatcgagtctaataagccaattttacacttgagaaaactgaggcttgaagttattacataacagtctaacgtcacataggtcattggagaaaggttgcaagtttccactaaaaatggtttggatgcagtcactgatggggctcttttagtctaaaagtcattgctttttaatatcagatcatttcagtaacatttctcaattagcacaagcatagttctcactaaatacactctttctgttaaaaaaattgttctgtaaaaaaatcagttttttttcattaattaggaaatcaagagaataatagaaagaactaagagataaaccaaggagggagcctgaagaattgagttctgggtcctgttctagaacattccatcatggactttggataggtattgtcaactgacctcagtaatttgtcattgtacttgaatgggaccagcaatgacaaaagtccttgagaggctgagacgaagacaataaaaatcttcccttggaaagaatcctagcatttttgtcagaaggaacaaaatagaatgaggtgggtgtatattttgatgaaaaataatctgatcaatcatacacagaaggaccataaacatgtgacactatcttagtacacatttccaggacacacacaccaaaggagaatgcccgtaaccggtgtgctgacattttaaagtaggaaaacagctttaattaacactctttgctaagcccttctaaaaagccaacctttccaaaataaatctttagtaatacactgttaatagtttttagaatttctgagtgttaaaatttcaaaagtgtttataaggagaggtatggccatcaggtactatctggagaatatatttaattaagaatggctaataatattaaggccatgactgagctgtctgtaacaccaggtatcagggtgaaaactgatccttgttatgttagcatgaaatgtaggtaatagagcaagaaatgtctataatcgggactgttagccacagagcccaaaatggtcatggttaactggcctgtctcgagcgcggtctttctgccggaagcactcagcatcctgcctttagcctggccctggctgacacactcctcctcatccccgtgggcccactgaaagcctgcccttgctgggcaacctgccaggactgcatccttctattgactccttctcacactggcctgtagtggcccgtttgcttgtgtgcatttcccatttgactgaggtaggccctcctacggcaagggctgtgtcttgtttaccattttatccccagggtgcagcagaggactccatatagcaagaggtcaagaaacatttgttggatgagtacatggtatgatgaccatcctggttgtaagaatgaggatgcattcccctcttttttcctatgaaaggaatagaccctcactttagctagtttattcaagagtttttataaggagaaggttccacaggattcttcagaaatgacagcttgtaactagaaaatgaccaagaactgggagagctttgtcttcctctcttctttatccccctttctccccttgcatgctccattctcctgctcctcaccacagagcagctttcttattcttgtcatcacagtacacctggctgcctcaagctcaattccacatgaccttcagttctgttgcttaaaagcactgatgtaaagcacgcagatgtcccaagtccaccaggcttaaaatccaatgtactcactgcagaaggtaggtaaaagcctaccacagtgaaacatttctttgtgtcttcccatcaagggggaaccagccaaaaccctttgcctcacatttgcctccagtcgccttctagaccaagatggcaagcaccaagactcggttccttctctcacctcagccctgaccccacctgcaaagagccacagccatatctgtgcctctgttccatgcatcctctccgcaccctcacagaagagaaggatacaacactatggcattatttggatgttgcctgatagggcaaaaagaagccatcaaggatgaggaatattttggtggtcaggccactagtctctgatgctgtgacatgtgtccagaaagtggtactaataggagactcagtctccttattcaagctttctgatttgtggtgttaagaaccagaatcctggaaccacccactagcttccctctgcaaatggccatcatggcccaagaataagtcaaacctggaaggattgtgagtctcatttcttgcattttgaggctacaatgtctgaaaggtcctcaggcttagggaccatgactactcaccactgcaaggagctattatgatggccactctacaacacctagagactcctactagcaggttttgaaacccatagtccaatgacagcctctgtgtcattcaattacatttatgagaaaaaaaaaaaaaggctacctaggtacaacttctgcggaggtaaacttccagagaaggtagcatgggcttattgatactccaaacatgtctgtcaaacatgtacttacatatctaaaagtagatagttccctgggcaagaagatcctctggcagaccactgacattgtgaaaggtagtacttagggaaagttaccctaaacacaggcacccagggagagttcactaaacactaactagtactgaaatgttcagttcactgaggttctctacactagttcctggtagaagtaactaaccattaccagtatctcattcatctctcattttggctaatggaagactgcacaactcggccctttgcatttgggaactggagggccatcagactattttctggccaatggattgatctgaggtagcaaatagctccagtctctcttcccctgctgtggccacctagaggtccatgtgttccaggtggtgcaatcaaacgatggtgaagacaccatcaacctgggccacagatgactgtctaggcactatcattcacccgtccttgaatatgcagtatattgagaataaactcttatgttaagccattgagatgttggggttattttttagtgcatgaaaccaagcctgttcccattaaaacactcaatcatctcaattaagttccaggtgaatcaagcccagtccttaagccaacaaaaaaggtttgcaggtctttgacctttgagccacctttcagaattaagaggacttctggttcttccagaattgggaaagagagagtaccatgaaccataagattatgaaacataattctataggagctgaatatacaacagcacttgagactctgccaattaatttaggactggagaaaccaaccatgactaatcaacccagagcatgccagaccacagccacgaatgctcataagaacgatcttcacattcagatcagtgggccatgcaactcaataatttctttcagacaatgacacaaaattgcctccccacttttctgccttaaactgaacactgctctgacctaatttcctacaattttgtttccagtcacttttttaccctcaaacaaccttataattgcgataatgaggcacattagagcccacagaagtttttaaggggaaattagatcagttcagggtattgccctcccaaattaaggtaattatcttgaaattcaaatgccacaaccagaattcagagcatcctactcacacccatgtcactcctcatcatatccactgtgttgtcattaataattgtcattccagaaacaagcatgccatcagccaaggcaggggaaatcacagtgttctctttaattcaactccacacaaacatggcagcccagaaaccttaggatccagcaagcatcttggtctcacttgaccctagggactgcactaaacactttccgtgaaacactctactgccttttcctagcaataggactgactcgtggtcctcctcctaccactgtgaccactccttcttggtctccttaacggagacctccccttacctccccttagttattgacattccccaagggcccattctcagtccattgcttttcctgtgctctcctcgaataatcttacctactctcatctaccaaatacaatgatgcccaaactcccctcctgagatctcaactcatataccttctgcacctctccacccagatattccacagacacttcagaactacatgcttgaaataaactcatcactctctcccaacctctttcctcattggtgttctctattctgttcagatgacgtactggtggaatgtgtacctccaaaagacatgtccacacggaaactcagaatgtaaacttacttgaaataagcgtctttacagatgtaattaagtttaggatctcaagataagattatcctaaagttggggtgggccctaatctaatgactgatgccctttgaagaggaagacagaggaaaatttgagacatacaaaggagacggtcacatgaaaacagaggcagaaattggaggggtgcatctacaaaccaagcacaccaaggatttctggagccacgagaagtggagcaagaaagaggcattggttcatgaacacaaaaatacagttagatagaaggaataagataagatctagtgttctgtagcacaacagagtgactagagttaacaataatttattgtatatttcaaaataactagaaggatggaattggaatgttcccaacatgaataaatgataaatgcttgagatgacaaatatcccaataagcctggttttatcattacatattgtatgcttctatcaaaatttcacatgtaccccataaatatgtataacttacgtatccataaaaattaaaaatatagaaaaaagttttttaaagaaggggaacaggacagagatatggagtggattctccctcagagccaccacaaggaaccaatcctgcggataattttgttttttggacttctagcctctggaactgtgagacaataaatttctgttgtgttacgcccccaggtcatggtaattagttaccgtagcacagggaccctaacacagatgcctgcctccagccatctaaaacctggcagacaccttcctctcactcccttcccattcccaagcaatcgccaaaccttgctggcttttcctccaacacattgcccacacctgccctcctatcccacaagtctccaccatcctattgaaatcctcaccatccttgcctggagtcccatcagagcctctgccctgatctcctaggcctcgatctctctctctcaagtccagcctttacacagacatcagaaataccttcttaaacagaaagaagagagccctaaagtagtgcttacagcccttccctgcctggccccatgcactcctccagcctcatctcattccactactcgttcccatgaccccctggacagcacctcaaactcctccagtacctgaattcctgaggttgtttctcacctccttgcatttgctcaggctttccctcagatcgggatcacctgtctttaccccaaaccctctacatcctttttacctaaatagctcctcagtactcatttttaatattccagcaggtatcacctcccctaacaatcatcctcccctggctgggacccaaacacatccaagagtgttggccataatacttaccatttaggcaccaatcgagcactgctaatgctggccacaacactgggccagggtcctgaggcaaccttatcccctgcggcctcaccaggtttaaccctatcattactgattctggtggtggagcaactggagcagccataccaatgcatgctctccaaatatcagctgtctccatttataatgttatatctaccaaattgcattataattacttctgtgtctatcaccccagtaggctagaaactcctctagggcaagtgtggaggtcttaattcatctttgtatccctaacagccagtaagcacaatatctgtcaaaagtagatgttctatgaggcttagctaggtgcacaaatctgagtgaattgatgagtgaatgaacacatgagtgcacagaatataacaagaaactattagctcccattaaattagaatagaggagtgtgagttgtagcagaaagattttgtgttgattcgaggaaacgttctggcaacataggacatgccctgaaactcatgcagctgagtgctcccaaatggagggttcattcctgaggtcctaactgagttgctgacctctgcccagctggttccgaggagcatagaggcagtgcactccccaagaaggaagcatcaggtgacctattagcgggagcagaagtacagcgctcacagccttgcatcctggattgggcagtgatccaggcatgagggcaggaggaggatggttaacacaatcggggttttgccaagcttggctgcttggcagtggaggctcattttttacctttgtgggtagcacatcaactatgacccatgtttggatgcttataacttgtcctccttccctaatatgtcataaaaagaaactcctggggaattttaaggagtgagaaaatgccgaggtcccatctagaggcactagatgatcccctgagactgtcatgaggcctaaattgtccatgaaagtttagccacaattacaggatttagcaaatttcatctacacatatttgcataataatacttgcaattacctagtaaaagagatacgctaaatgcctcagaatggaagcttggagctcagtgaacagtagaacaaggcatacctgaccaggtggcaacatggagatgaggttatctgtgagactaaggaggaggtactggggccagctgaccacctagcacgtcacagggtgacatggcctacatgaaaacctactttaaaacaaccttgatataaactatgtgatgtggttgtacaaaggtataatctcaatacggttgcacaaacttatattctaacctgtactccagcggtgcttaattagcatttaaatgctcctatcaaaaacaacactagagaggttagtgaccagaatgagaagctgctaagaatttttttattgtgtaatatacataacacaaaatttaccatgttaactagtaaatgtacaattcagtggcattaaatacactcatattgttaggaaaacatcaccataatccattatccagaacatttttcttcttgcaaaactgaaactttgtatccattaaacaataacttcccatcaccctgtctccccagcccccagcaaccaccactctactctctgcttctatgaatttgacgactctaggtacctcatgtaagtggagtcacacagcatttgacctttgtgactggcttacttcacttaacacattttgaaagttcatccatgctgtagcacgtgtcaggatctcgtttctttttaaaggctgagtaatattccattctatagacagaccccattttgtttatccattcctccatcaatggacatttgtgtcacgtccgccttttggccattgtgaatgatgttgctatggacatgggtgtgcaaatatctgttcaagttccagattttgagtcttttgtattttgtttctgtttgttggttggtaaaatcaatgacatttgagactgatggttggtggggcacatgcatagcgctccctgcctgtgcagaaatggtccgtagaaaccaggcagggccagcagcctgtgccagaagagcagagccctggcctggaggtccatagacccaggtccctgagctgagctggccataggacaccacaggcccccagccagagccttacttgcaagtcaaggcctgcagcctgaggacaggaagagggcgacacccgtctcccttcttggttacctcctgcaaaccacaagggcctacctctatttacccagattggctcaggctagcccatgacacagagagagcaccatatcagtacaccatgggttaaatgagatggtaaatgaagtgagtacacacacagcccctagaacattccaggaacttagttaagtgctcaccaaatccaagctatgatgtgccagcatagcagtaaggcaaaggtgtgatccaggcagggatcaatgtcacagttagggatgggagtcagaagatgccaggtcaggggcaggaggacagacaggacaagtgtacaggtttcctatggctgctgtaacaaatgatcatgaacttactggcttaaaacaaatttattctcttacaattctgaagatcatgattctgtaatgggtctcacttggctaaaatcaaggtgtccgctgggctgcattccttcctggaggctctgagaggagaacttgttcttccccttttccagaggctgcctgcattccttggctcatggctcctcttccatcttcaaagccagcaaccaaccaggtctttctcacattgtgtcactctggtttcctcttatacctttctcttctacttgttatcacacagtcctgcctcaagatgggtttgggcaagaacataattgccccaagtccctgacataaacgggtgtagtatgcgcatataacctgcatcctccacattgtcatcaatagtgacagaacccttgggataacactgggcccacccagataatccaggctaatctccccatctactggtatgaaaccttaattccatctgcaacctccattcccctttctcatgtaacctaacatattaatatgtaccggttccagggattaggatgtgtacatctggggtgggggtcttattctgccttcacaagtgatctggcaaaggcaatactgggagatccccgggagagagtctgaatcaggcagcagaactccaagtaccagggagaagtataagaatctagcctggccttccaagagcaaagcagagtgtgaggtctgagttaacggggcattatcatagcaaaaacagtggcctaggaagccaaacaggggcccagctggtgagactggggtacaagtggaaacttagtcttgagaacaaggtagaaggacatttacagtagcaagggcaggataagagcagcatttccagcaaggctgatggaatgtgtggttgtctaagaatgtaatcaattattagagcagcctcaaattgtcctgactttgaagcaaggccgatcacatcttaaagttagaaggcaagagtttgtgggaaacagcacattctggttatgagccccatgttcaagggcagaaggctgttggggtatcaaacccaaccaacaggacaaggggaggacaagtacgatggaggacacaaactcagtgaaacaaggagatgaaccaatacacacagggcatgctgaggggtgaaaagccaacggcagccactcagctacccagctcgagctttgctgcagaagcatgcaagctgccagtcaaaacccacccagacagcagaggaggactgtagaggggtcctgggagagaaagcaaagaacaacgtggacaagagttatccaatgtgaatttaattccatttctgctgtgcagccagtgatgtgaatttctttgccatctcttcagaaaatctaaggccaagtatccccttctcattaatgcaaggtcccatcagatctgcttggtggatgcttggaaacacccagtcctgcttcaagatgggctggggctcgaggacataattgccccacagtctcttatgtcaccaaagggagacaacttacagacacaacttgcagttgttcctcagtatctgcaggggagtggttccaggacccccagagataccaaaatctgcagatgctcaagtccctgacataaaatggggtagtattttcatataaccttcatccacctatgtactttaaaccatctctaaattgcttataatacccaattttatggtagatgcacctgacagcaataacttgacttgagcatatcctgagaatgactgtgtatggcagatgcacctgagcatgtgttcagcattctgagctaaggattccgggagtgaacaacccagagatcaattccttatctatgaggagcatctgagcccctgacccgacccatagtattatatataagctgcatgtgttctgtaagtggttgtggttctcctgcccagcccgccaccactggactctctccctgtgtataagcccccctataaaaacccatgactcatttgctgcctctgagtctcttcttcagactcttgaacctagtgctatccccactgcagtcaataaaggttcagcacaacaccaatacgatgtaaatgctatgtaaatagttgttatactgtattgtttttgttaggttcaagttcagttccagcccatgttgaggtctgaagggagtgggtggatgagtggcaaacagttcaaagagcactgggttgggggcgtaggtaggtgaaatatggctttattcagcagctttctcatcagcagctctcttacactgtccactctgtatcagctgcttgagctggctgctcccacacacagctgcgcagccggctctcccttaccttcagggtcagcagcttaactctctctgggcacaagtgcacctgtacagtgtcagcagcgcaattataccttttacagacaataatggcttagagccaagtgatggtcttccaacattatggctacatagctgtgataacaagtggagttagacgcctgtgttctaaactcgctgagttatgcaggatatttacctcagcccatgcccacttggccgcagggcagccatgttccttacagcttttaatttgtattttgtattgttgtattatttaacatcttcaatccatgattggttgaatttgtggatgcagaatctgcagatacagaggaccaactatacaagaaagtcaaataagcatagagtatgaaaagggacctctctcccctttttattctccttttgggcttagattctgtttttttcttaagggaccttcagcactgttttgtttaagctgccgaaagccctgtggtcctgtgttgtaattagttttagccatcagcagaaagcacctttgtttcatatctccaaagtcaaaaccaatcaatacaccctacactttattcctcccctggtcaatcagaaggtcaactggaaagaaactctccaccctggggatgatggaccctaggaccacaaagaaagctaaacgcatgctgccttcttccactttcccctgagaagctgtcagaggtgaacgaaagggcactgccgaggatggtaataatgaatgttacaagtgaacctcaaaaagcgggtgctaggacccagatgaagctccaacacatgtttccgcattggtggcttttcacagcctggggcctcactattaaaaatgaatatattaattggatcacagccagcccttttaactaaaagtttccgatttgcaatttaataaactgctgccacagtgactagttaatgaaaactagagcattaagacccccctcaaacacctccttgccagccttatagagctggttatcaacagcacccattttaaacaccgagcctcatttcagaaagcctcaagatcacgtatggtttgccatgcaagaattactactacaaaatgattttaagtctgcttataaggtacaacgctgcttaaatccaaaatggaacactgtttttagattactccttctggagaacagtcacatcccccaggtatttaccatcaaataaaatgatggccaagcacacggtgacctgagagcagagacagtcattgggtggctgtcagggagcttgggaagaaactacttctgccatttttgtgcaatcccaaggaaaggaaaagaatgttcggtaagagaagcagaaggaggtcgtgccttggcattaacttcagtgaatcaagcataggctgtagtctcagttcagttgccactcacctctaggctggaggagaaaacatcaaggtccaaaattaatggaagccagaggccttcccaagcaagtcctaaagttgtgaagctgattggtggaagacgagtgcccgtggggccactgtcccatagtacctgggtggcactggattcatcctcaacttcaccccagagatggggctagacaagcaaggcagatacagctccacaaagagtgagctcagaactcaactggatttaggtctacagactcagcccgcaggaatctgtgcaacacttttcaggtgactgattaaggtaaggctgattccacttaacagtactgatgagtattgccttccactgtgtcaaaataccctccacctgactttcaaggctctgcgtgatctggcctaggctctgcgtgatctggcctaggcctacctggccagctttatttctcataagcaccgatcttcccactgtcctgcagatttcctgtctttttcctgctctccttttccagaggcccatccctcatggtccatgagataaaaccatcacatattctctgagcctgagattctgagttgtcagaccccagggcgccacaggaatgccagcctgaggcctggggaagctgcatttttacaaggccgtcatcaggagacatagctcgaggtccagatccagacccctcctctacgtagctccctcattatccacccagggtttcccaagctgcaggatgtggccccctagtgacatcaactgggggacttgagagggaggtgagcatctctaatgaattgcaatcggattggaagtgtcaggaattcgtgcagaatccctcagaaatatattttcctcagagtgatctccctgttggtgcacagtcacctactcacaagataacggtgtgacaggtaggccccaaggtgggttgttgctacaagaaattggaaaatgatgatctcaacccataggctccacctgtttttagtctcacactccatgtttaaaatgtttgaaaataaactctcaatatatgttatcaactatagtataccaattatatgtattaactatatatatgtgtactactctataagatgtaccttataaacatgcccaaaagtagaaattaaaggttacatagaaaaataaatagaacataacttccaatgtttgctatgtccatgccagaacctgccctttggagatgatgactctggccctcaccactccctcacttctctgagttcctccttttctccaccatcacaaaattcagcatttagaatatatgatccctgcccacaagtttctcaaaatctggtaaagtgtcaggtgcagtggctcacacctgtaatcctagtactttaagaggctgaggcggccagattgcttgagcccaggaattcaggaccagcctgggaaacatgatggaaccccatctctacaaaaagtacaaaaattaaccaggcatggtggtatgcacctgtggtcccagctactcgggaggctgaggtgtgaggatcacttgagcccaggaggtttcaactgagaccgagatcacgccactgcactccagcctgggtgacagtgtgagaccctgtctcaaaaaaaaaaaaaaaaaaaaatctggtgaggaaactgatatacaaatatgtcaatataatacaagacagaaagtgccaggatgcaaatgtgaacaaaatgttgtggcattacagaagaggcagctctcggtcttcccgagagacgcaaggaagacttcatcgagatggtgatgagtgagctggatcttgaaggctggatgggtggtgccaggctgcagaggaggtgggctctccagagaaagagagcccgtcgtgttcagctgttcctgcccttcagaatcacgtgggcacttaaaaaaaaatactctgaactcctcctctcagaatctgactcaggaggtctgcacagggagggcccagcatttgcataacactcccatccccttccttcctcacccctgcagcaagacagcaagaagtcatggaggggcttccagtggggctgcaacagtagctaaaacttgatttaaaactcaaagcttctcagtgtgtgggagtagcataaacatagaagcaagcaggtcactaatgcagagcaattttttcttaaattgatacagttcagcctcgaaccatatattagtcagctcagaatactataaaaaaatacaactcagtggcctaaagaatagacatttatttttcacagctctagaagcagggaagttcagaatcaaggtttagttcctggtgagggctctcttcctggcttacaggtagccaccttcttactgtgacctcacatggcagagagagagtgctcatgacttcatctaaacctaattacctctcaaaggtctccatcacattgggagttggagttttaaagtataaatttacagggctggagagaaggcacaaacattcagtccataacacgccacttacactgaagtggcaaaaggcttaatacccccaaatgctggttgcctgtacatcctttgtagaaaacgttgttaatcatttctccagctaccagccattcctcttcattcctttttttggtaaacttctcatactttctggagttctcaccttggctccaaaagtaatgactgtagctcctaagtgattaatttagggatagaaatcccctcaggaaatccaaaccaaggagagacagagactctggagactttggctgggactgctaatggagagactaggatcttgtgttatattgacatatttcccttcccattcctacctgaatgatgagctggataatggtagacaacctatggcagtcatcttgctgttatggggtggggaaggggcatttctgagaaataattcatataggaagtagagctaataactgaaaaagaaacaaccagggcatggtaacaatgccagagtcctggagtctggttcaccttttccattatgtaaatgaaaatttttctacttttctttaggccagttggagtggcattttctattacttacaaatgcaagggtactaatgatacatcttccatgccccagacatactatgagctaattggaaactcctaactcctgtaacttctatgagcatggtaggaaattggcaattttttttttttttttttttttttgagatggagtctcgctctgtctcccaggctggagtgcagtggcgtgatcgcggctcactgcaagctccgcctcccgggttcacgccattctcctgcctcagcctcccgagtagccaggactacaggcgcccaccaccacgcccagctaattttttgtatttttagtagagacggggtttcaccgtgttagccaggatggtctcgatctcctgacctcgtgatccacccaccttggcatcccaaagtgctgagattacaggtgtgagctaccgcacccggccagaaattggtaatttttactgattaggtgaacaaacaattcttttccaaagcagaaacattcaagttacaatggaaaattttatctttccaaagaacaattttagacacaattatcattgtttacatgatcatatgtttaaataaagtcactttctttagcatttagaaaagaaaccataaaatgtaaatggccaaaacgtatttgatctatatacacagtatacgtaataaactgcagttacaagaggttcctctgatcttcactaatccgattctataattttctaagattcccttccaaaacccaaatgtaaaattaagattaaggggtcattacaattaagttcagttaaacatgcatccattcaacagtatgtcaaccaatagggacaatgtgcttttaagtaccaaaccccataccaagcattagattcatggaccagatatagatgtcttataaactatgatgaaactagacttgataagcaaaggagaagaacgaattataccacattgttccaggcattttgtagaaaggaattccatcctatctgcaaaattagccttcaagccctctaaaatcccttccaacctaaattttaattactattttcaatgtttctacttcctattttgtaagttctataaaactgggaaaaaatataataaaaaagattaaaagatagtaattcctgggttgtctaggggcaaacatactgtattaggattctttggttgtaattgacagaaattcaattagaatagtttgggcaaaagaaggaaagcccattggctcacattaaacacactgtccttgctaaaggtggggagaaactagagactcaaatgttttgggaactctgtttccaccttgttctcagcaagtacactctattatttcagagtagccaagtcctgaggtcagacgcagagctgccagcttccctaaacttaatttgtcacagttttttgaccagaagaagaaagactccatttccagtctacatctcccaggaagaactctgattggccagtttaggttcaatggagggcgaccaaacatcccactttgcctgagactgaggaggttcctgagacatgggactttcaattttggaactggaaaagtccacgcaaatcagaacaagtttaaccctagttaaaagccaccttctaaccaattaccgtggctagccgttgccagggagttggaatttacagggcccattcagacctcacagtgggatgaggaaaaagaacgacttccatcataaaggaatgggttagacatgatcactaaaatgtgattactctcagtcaggcagctgctccaatttgtttctatcatatatatctaaaaatttggcaagtgattcctgaaaccattccaatcaaataaacttgtcatggaattttaatttcttaaactcaccgcaatgaatcatttccattactgcttcaatgtaataaacactaccctaatgaaccaaaagagttaatacacagcttaaatcacctccatatctaagaagcccaactcatttcttagaaactatcccactaagtactacattaatcatttgtcatgtcttcaaaactactatactctgtcaaaacacatcttatagtttgatgttaacagtctgaagcatttgtaacaatataacacatgcatactgtcaaattgcatatttcaccttctggcaattttcttctcttgagaacttagtttctcctccatgtgctttagaattgcttgaattctttagctcattctttcaggaaatagaattaatatttaaaggcagtaacagtgtaatttcaagaatgtcttagtaataagcagagttctcataacataaattaccctatcctttcaatagtcttattcccttttccaagtcacacaatcaagataagctgggaaaggggaatttcaattatattaaatctcccaggaacacttaggtttgctgaaccagaatgcaaagtcaacaaatacagagacacatggacatatctcagttgcagtaggtttcctgtgcttttaagaaaatagattcagtaccaagtgagcaaagtagtatagtgtaagaaaatatcctggatcatgaaggcacaaaaagtcataactgcctacagctctcccactctcagaatttctgctgaccacttttgttccagttgtacaaactgttagtcactctggggaccacttattgtctccaggaacacactgatgtctctagcatgaaggatctttttctcctttgattcaacagattcaagtttcatatttatccaaagaacatttactagaaaaataaaggcaaataagcagtagaatatacaaaaggacagatatggatatatttacagagtaaaggtactttgttctgaggttgctgaaataagacaggtcttggctgggcatggttgctcatgccattaatcccagcactttggaaaactgaggcagaaggatcacttgaggccaggaatttgagatcagcctgagcaacatagagagactccatctctacacaaaattttttttaaaaattagccaggcatggtggtgcacacctatagttccagctacctgtaggctgaggtaggagattgcttgagcccaggagttcaaggctgcagtaagccatgatcatgccacttcactccagcttgggtgacagagtgaaaccctgtctctttaaacaaaaagaaagaaagaagaaagaaaagaaaaaagaaagaaaagaaaagaaagaaggaaagaacagaaaagaaaggagagaaaagaaaaaaggaaaagaaaagaaaaggtcttatctccttctgggaaaaatcaggacccccttgtcctcagctctagaggacttagatgacacactactcacaaccctagtaggagacacaaggctcacatattccctaacccccatttcatctcacacccaaccttttcacaaaaatcaaacaagactaggtatactagaagctggaagagagaatgggggaagtacatcattgagaatggacagaaagacctaaaaagaaacagaaagtcctagaaaagaaggaaagaggagataacaggttatgcatcagcattaagaaaaaaagtagcaccagcctcaagtctagagagcaatcaagacatcctgatgagcacagtgagcctgggggatggaaggagcccccacatttgggcataggcagagtccccactgagtctgaggagggtcagtggtcctaccattctagggtctggaggatggtgaccctcttctcacagctccactaggcagtgtcccagtggggactctgtgtgggggctccaaccccacatttcccccctgcattgccctaatagagggtctctgtgagggctccacctctgcagcaggcttctgtctggacatcccgacttttccatacatcctctgaaatttaggtggaggctcccaagcctcagctcttgcactctgtaaacccacaggcttaccatcatatggaagccacaagccaccaaggcttatggctttcaccctctgaagtagcagcctgagctgtacctgggcctcttttagccaggactggagcaggagtagttgggaagcagggagtagtgtcccaaggctgcacaggtcagtgggggcctgggcctggctcatgaaaccattctgtcctcctaggactttggggttgtgatgaaagggggatgctgcaaaggtctctgaaatgccttggaggcctttttcccattgtcttggctatcagcacttggctcctttttacttatgcaaaattttgcaacctgcttgaaacctcccccagaaaatgggcttttctttcctaccacatggccgggctgcaattttccaaacttttatgctcttcttcccctttaaatataagttccatctcctgagttcaagtgattctcctgcctcagcctcctgagtagctggaactacaggcatgcaccaccacacctggccaatttttttctgtatttttagtagagatggggtttcaccatgttggtcaggctggtctcaaactccagacctcaaatgatctgcccacctccgcctcccaggtcatttctttgctcgtgcgcatgagcataggttattagaagcagccaggccacatcttgaacactttgctgcttagaaatttaatcccccagataccctaaatcatctttctcaagttcaaagttccacagatccctagagtaggggcacaatccaaccaagctctttgctaaagcatagcaagagtgacctttactctagtttccagtaagttcctcattttcatctgagacctcctcagcctggacttcactgtctatatcactatcagcattttggtcacaataatttaacaatcttctaggaagttccaaattttccctcatcttcctgtcttcttctgatccctctacactcttccaacctctacccattcccagttccaaagacacttccatattttcaagtatctgaaactgctgtaccatttcaagagtagcaatgccccactcctcagtaccaattttctgtattagttcattctcacattactataaaggaagacctgagattgggtagtttatagagaaaataggcttaattggctcacagttctgcaggctgtacaggaagcatagtagcttctgtttctggggaggcctcaggaaacttacaatcatggcagaagataaaggggaagcaagcacatcttacatagccagagcaggaggaagaaatggagggggaggggctacacacttttaaacaaccagagctcatgagaactcactcaccatcatgagaacagcactgagaagatggtgctaaaccattcatgaaggatccacctccattaaccaatcacctctcaccaggccccacttccaacactggaaattacaattcaacatgagaattgggtggggacatagacccaaaccatattacaagcctatgtgtgtgtgtatttttgagagagatatatatatatatgataatatgatatatgatcatatatatatcatacacacacatatgcaatatgaaacaatacactgtaatgttttaaaagtgatcttagggtataaataaggtggggggttttcttattcttatttatctgtatattctaattttccaggatgtttacttgctgcatttgcaataatgaaaattatattttaaagaaaaaataaaatccatttagtactttcattttgagcagtataaaagaatagaccactcccattgaaacaactaaaagtgctagataagacataaaaaccccttttaaaccttgtagtctgttttcacatggctgtaaagaactgcctgagactgggtaatttataaagaaaagtggtttgattcacagctctgcatggctggggaggccttaggaaacttataatcgtggcagaaggtgaaggggaagtaaagaatgtcttacatggcggcaggagggagagagtgatgggggaaactcccaatcactttcaaaccatcagatctcataagcactcactcactatcataagaatagcatggtggaaaccacccccatgatccaatcacttcccgccaggtccctccctccctacaatttgagatgagatttggtggagacacagagccaaaccgtatcaaacatattaatgaaagagaaaaaaaaagacttctctaaagtgaaaaaaaagtaaaaaaggaagccagtaaatttacttcagttgtgggcatgttaaaatttctagagttgacactaaaagcatagaaagagtgtagaacttctaaactagtagagatgaaaaatagaatagggcaggagaatccgaaaaaaaaaagaagaaacaaataacaaagacaaaagtgtatggtaaatatttacccaaatatatgttatgataataacgtaagtgaaccaaaggattcagtaaaaaaatgaagatgaccaaattggattaaaacatctaactacatagtttacaaaaggcacatataaaaggatccagaaagtttcaaagaaaaaggataggagaaaagtcagaaaaatagtagccaaaagaaagctgtcatcactctattagatattttatagaatagctaggtagatagataatatataaatatataataaagataaagacatatatatgaatttaaatattagatatatgaaagaggctgggcttggtggctcacacctgtaatcccagcaatttgggaggccaaggcaggtggatcacctgaggtcaggaattcaaggccagcctggccaacatggcaaaaccctatctctactaaaaatatgaaaattacccaggtatggtggtgcatgtctgtaatcccagctacttgggaggctgaggcaggagaatagcttgaacatggaaggcagagtttgcagtgagccgagattgtgccactgcactccagcctgaacaatggagtgagaatccatcttaaataaataaataaataaataaataaataaataatacatgaaagagagcaaaaagcatttctaaatataggattaaaacaaaataacagtttttaatttaccaggaagatacaataatttgaaatttgtaggcaactcttaaaatagactcaaaagacaaagcaaaaatgacagaactatgggagaaaaattcaaattgacaattatatgggaaattttctcatacctcttttagcaattgatagatcaaatggacaaatatatatatatatataatgtatatgtattattaaagctggaacagatttgaacactataatcagtaagatttttttaagggaactgcaaagaacattacagccagaaaattgggagatacaaactcttctcaagtgtacatgaaatatttataaaaatcaacaacatattgggccataaagcaaatttgaacatattttaaagatttgggttgtacagaccagagtgcaattgttagaaatcaaataaagagataagaaaaaaatattttatttgtataaccatagagttcagactgccataaatttagttatagtctggcaggacaagctggccatagagaatcctctttagggttctaatagatgagtatcagtgaacgaccaccaatcatccaggacaaaattaatgtttgagtttgtgcataaagggttgatttggacttcacaggattatttcttctttgaaatgtgggaaatcatttgttcctacgcaattcacaaggctatctggttcaacccatgctttcccaagtcaaaatgttctttcccacagcccagcaagataaagtactcaggacagctggattttaagaacacctttgtgagttgggtctttattgggataatcagagaaaatgactacatttaggtcttctttcatattttatactagtaccagaaaatacaaattgggtgcagaaaacctgggtgcatgaacattgcatgtttaaaccaagctaaaaagagaatttgtagccaaactacaatggaacttattgatgatggctagagaactgctatgtggtaattttatgtttgacatgatatgtagttctctttacttttatttggaaaatattctggaccttggaaaagatgagtgtgaatttaactatgtgaggttagaagcacctctgggagccctgtggtcagcagactcttcaggttgtaactagaaccatgaatcaccattctggacacatttagggtttttaggtctgtttctattgatttacacaacactctaggagaaatcacagactcagagataacaccatttaccttgaaccgtttcatctccaggtgcaaacagaaccctgggcaattgttaaaggatgttattgtaggatattgagaaaaagggtcattgcatcaaacaagaggtgacaagatgacagaaaaggaatggaaggggatagtgagtttcaaagtgagtttgagtgtaactgtgtacatttggctcttggctagagccagactacaagttactcagtggataactaacactgaaagaatctttttattgcttgccttatctgagctacttagttcaggagcgggagcaacggtggggccggccttaacacagtgcttcccgagctgcttcgcgccatggattcagagaaggatgattccttttcagtgcactgtgggaggctgccagccacctggaccagcctaagcctactctctagcccaggtccttccctgcacacaccccaggctggaagagatcaatattgagtccaatattgagaagctgatgttaggacccccaaatgaagagctgtgttacaggtatctcaaacttgacatccaaagcccaatgcatgggcttccccccatcgtctacttctcccacagagttcccactgcagcaggcggcaactccattctcccagttggccagacaagagctctgaggttgaatcctgactcagctcctctccttacaccctgttatgggctgaattttgtttctcaaaaaagatacgttgaagttctagccccgaataactccagatatggtcttatttagatcagagtcattacagaggtcattagcgaagtttagataaggccatacagagaagggtggatttctcatccagtaggatggtgtccttataaatggtggaaatctgaacacagacaggcacacaggggaatgccatgtgaagatgaggcagcgatcagggtgacacttggaaaaaaccagcaaagactgcccacagcccaccagaggcaggacagagcctggaacagacctcacagccctcagaaagaactggccctgccaacaccttgattttggacttctggcctccagaactgtgtgacaatcaatttctattgtttaagctacccaatgtgtggtattctgttccagttgttctagcaaagtaacaaacactcctcattcagtccaacagcaaatcctctgagcactgccaggcagagcctggtcattccattctgttcctggcgaggctcccacgatctggcccctcagtatcactcccagctcacagcctcactcccccctcttccttgatcatccctcgcacgctccccactcagagctttggcacggtgcctgctgttcctccacctggaacattctttttgcagggatccacggacctggctccctcatctcccccaactctcatcttcccagggggttcttcctgaatcactccacacaaagccacagtacccctccccaaccctcagtaccgaccctctaccctcttttcacatactatgcattttgattcctgtacactgtgtagctcaccacatcaagtggtgacatttatgaagctggggaatcttatctgctcttttcactactgtagtcctagcacatagacagtcccttaatttataattatggaatgattaaaggaatgaatgcttcttaacatccacgacctcctactcagacccaagggaacaactctctacctgtgccatggtgattctataaagcctggccctgatgggtgggggctgcagatcttggcagcagaagagaagggttgcctgcaccatcctaaactgctaaaaggccacgcaagcgtggtttcaacaggaaacatttaaaggttccttacgatggccaaataagaagaaaaaggaaaaaggaaatggctcatgaaactacctgcaacaaagaaagagaaaaataagatcacagaagaagccccacatgccaaatggcaggtttgcatagcatggggttgacagagatacaccaggctcatacaacatattttggacccagtgtgaaaacaaagaaaagaaatagagcaacactgttaaagcttccaaaagcaactatgatttctttgtcattcatattattatttcattatactgtggaagcaaggaaacttacaaaacacattaagaggcagttcgaaaaagaaaccaccaaaaggcaataaacatataaaaaaaagtgtttaacctcacaagtaatccaagaaacacacattacaacaaaaacaaaacattttcctatacactgggaaagtttaaataataatatccaacgaattccagaataagcatagcaatataaaattggcataatctttctaaaggaaaagttggcattatgtatcagaagacttttaaaacttatatttcattattcaacagtgcttatagtttactccaacttgcccataaagttttttgtatgtaaaagataatggcaccctccagtcagcccatcgccatggattttacaagctggaattggaaccaaagtgtgtcaactccaaaaatcatggacttaagctctcagcgtcccacaagagggagagtgggcctgccaaacttaaaaaagactttagattcagaactactttcagtctattggcaaatgggatgtaaaacactttctttttttttattgagacgtagtctcactctgtcgcccaggctggagtgcagtggcagcgatcttggctcactgcaagctccgcctcccgggttcacaccattctcctgtctcagcctcccgcgtagctgggactacaggtgcccgccatcacaccaggctaattttttgtattttttatagagacggggtttcactgtgttagccaggacggtctcaatctcctgacctcgtgatccgcccccctcggcctcccaaagtgctgggattacaggcgtgagccaccgcgcccggcccaaaacactttcactctatctagtaaaagccacgatttgacctgcagaatgcctgaacctagataattctgagccaaatgagacagcatatggagcatttaaaaacccaagcacagaggacttccgactataggaacacattaccaattcacatcacaatgatgtacttagaaaggttatcttaacaagaaattttctgacattcacatgaataaacgcatgtacacatctgaatagatttaagatgcgtgcttctagaactctgctaaagagctttaacttgagacacaaaacaccagttaccttgcagtctcaagcctaagcaatttagcattattttgaaagcctttgtcataaaagcaaacaaaagacaagcagggctttgcagtgtctcagcctgcccctcccgtcagcccattgccacgggattttacaaggttagttgcaaacgtggacaagacaactctggtggtgagctcttctctcggaattaatacatttcaaagtcgagagccaggcaagtggcaatgctaatcaagctagtgacagcattaatctcctttggctcagctcaaaataggatatgccacaggtgaccccaagtccttccctccccttctcaagccattagctgaacatcatatttctttctgctgccaacgccggcgccagcagcagcacaattcaaatgggggaaagagcacatgtgacaagaacagcttattaactctgtccgggaatttctgtgctcacctatggctggttctaaggtattctctccatttgccaaaagtaatgagaggacagccctttgccaattaccctacacacctcacagaaagatgaacagctaaaagtattaagattcaaatttaagttgtgtgttacaacaaccaacgaaaggtttttgccaagggaaatttcaggaagtgatttaaatagaaatgaattgtcaagaaaaacctaggtgtcgctattctattgcagtatctcagtcatgacaaggtgccacaaatgatgtgaaattacggtctgacaaggtatcagatctgtttaaatccagccaagctctaccatgaaggaatggcttaaagaacaaacctggtatgagtgtataaatcattctccatcaacaagcgttctatggagaacctagaaaacccaatcctaagatctggaatcatctgcgtaagcagggaaataccccttgatgctaatttccattccttaaaattctaaatgccccgtaatttaaaggctaacaggctgtaaatctcccttttaaaagttctttactattacatgcagatgcccacgtgcccttctatccagcttataagagtccaggattctttcccaggttctctgttttgatcaccttgcagagactaggatggtgctgcagaattcggattcgcttctgttggcagcttcccactcttgtcaagcagagtctaagtcattgctgctcatttccagatctgaagcacatctttatttctcttctccctcctgcaacatgtggtcttcaggaggtcgccatgttctccccttctgaattacaaattctagcaaaagtctctgaatctattcctttggagaagaaagtaagggaagaaactaccatgaaagcactttccccaactcctccaccatgaacaccttggatcagactgcaaccaggttgacccagtggggccccagattctgcagtgaagaagccatgtttagggacccctgaccccacattcagccacagcttgttggaccaactgtgaacacatgacccaagagccatcaaacagtgggctggcaggtgacttgaagcagaatcccagcagcaggtgacagggaatatgtatacctcagaaaagggggagtaagatgcaatttagagttagaaatgcatggctggagaaaaatcacacctgctgttttcacaatacacattatagaaaggagtgtttgatgactttctgggcctgtggagatgcacaggagatagtgatgtgagatttcaagggtggaacaacaccaaaaagagggtgagaacaagataatcatggcaggggtgtggccttccccaggcttctgtgtatgtgcatcctacaggaaaaccctaaatacctaaagtaatacaagtgagtcacacctccttaaaaccaaagagtctatggaggacattttaaatggcatttaaattaaattaataaaggagagaaagtgatattaaaattaatttaccactgaattatcattatacaatcatttgtatataacttaaaactattttccctaaaaatactgcatttctaagaataacaattattttatatgtattcatatatatatatgatatgatatatatgatatatatatatatgacatggtttggctgtgtccccacccaaatctccccttgaattgtagctcccataatccccacatgtcacgggagggacctggtgggaggtaattgaatcatgggggcagtttcccccatgctattcttgtgatagtgagaaagttctcaagagatctgatggtttcgtaggggcatctgttcatgcagatgcccatgtgcccttctatccagcttatatgactccaggattctttcccagggttctctctttcccccttcactaggttctcatttttctctttcctgacaccacgtgaagaaggacatgtttgcttccttttctgccatgattgtaagtttccagaggcctccccagcctggtagaactgtgagtcaatgaaacctcttccctttataaattagccagtctcagttatttcttcacagcagcatgagaatgaactaaaacaatatcccttggacaatatgcaatcccagggaaaggactaacaccactactaaaaagtaacaagcggccggacttggtggctcacgcctgtaatcccagcactttgggaagacaagaagggccgatcacgaggtcaggagttcaagaccagcctgaccaacatggtgaaacctcgtttctactaaaaatacaaaaatgagccgggcatggtggcatgctcctgtaatcccagctactcaggaggccgaggcaggagaattgcttgaacccgggaggcggacgttgcagtgagccaagatcacaccactgcaccccagcctgggtgacagagcaagactccgtctcaaaaaaaaaaaaaaaagtaaccagcttatgtaccatatgtaaatttctgtggattgtatctcactcaaaaatggtctggttaaaaaaaaaggataatagaattcaacatgtcattaataaagttacttgaaacaaccagtgctaatgatttcttttgagagactgaatatataagcagacaattgccagaacatacataaaaataaaactgtgccccacaactgcagcaaccagcccaggtaaccaacttattatccatagcaaccagcccaggaagccagcctgttctctgcaagttagacttgcagaaagtcagaccactctccctcccttgtaacaattcaggacgccaaaaaataatgcctgtaataattggccccaaatggctgggacttgattcataatcacagtattcctaatttttaccctacttcccatttaggaccaaccagagaaaggcaaatatgctcccccaaccaatcacactggatgccctgctcctggtgagccgcctccagcttcctcaggccagcagcctccaatcagggcacacccagaacctccccttcttccatcacgatgctttccccctcctctgtctgcctctgagtctctgagaaacacaatgatagtggccaacttccttgctgtagcaagctcagaataaacagccttggcttgttctcatttgcttggtcttcatctatttccacgcattgatggacatttctaagaagaatctttataaacacaagcaaggcagtaaagcaaggacagcaaaggagtggggatacgtcactggggcacctggatgtgagaatttcaaggcttgtcttttataccatcttgcctgaaagaatgttttgagtccttattcatatgacacatggaaaaatttgtgagcccatttctgtaaagcatggtttccataatgtatagatttcataatcaaaacaagaatacttttccaacctaatgcaatgacacttccaaatgaaacagtgaaaagaagatgataaaataaagctgggccagctgggtgcagtggctcatgcccataatcccagcactttgggaggccgaggtgcaaggattgcctgagctcaggagttcaagatcagcctgggcaacatggtgaaaccccatctctactaaaaatccaaaaaaaaaaatacaaaataaaagaaagctagaccaatgcagagttccccaagccatcccaaaaattagaaatggaagagtagggaagtcattgttgctctattgatcttatcaatttcctttaaagagcctattgagaaaaaggaaactaataatctggttaaagaggtaaaaagaaaagccagacatcgggtgtccacaactcacccttgctcactgagcctcaagccacaggtcttaaggcccccaccgtgggggttgaaagttctcagcccagtagatgccctgagctgacagcacccccaggaatgggagaacagggaaggatgttcgaaagtaacagaggtaaaatgactttcctccctgcaaccatttcccatggaacactagccttctggtacacagactctcagactcagaaatcagcaaaacaaacaaaaatccccacaaaaaggaaattacagagaagaaagcaccccgcagatccttgtgccacgataaattagttatctaaggaacacaagcagttaaaagtcaggcacgcatcctgtcaatattctgcagggatctagttctgctgaaaaacttgcttttcacaatatacctcaaatctgtcggcaataattacctgagaatcagaaaggtgacattttaaattttagtgacacattaatgaacaagggtaatcctcttgacagatacagagcaagattcgccacaggaagcaaagcaagagctcctcagatcaaaacgtaagccatataaccggccttggcaggcccggtgcacatcaaggccgcacttcagatcatcgcggccccttcagacccctcgcagccactgacatgtttactacttttattttccctggcagatgtttggcagacatctcgtctcagaagattcgtgcctttgtctcagagtcgagggttaataggacccttaattgcggtctcagttataataagatcctgcctttttaaaaagaaatgccttctacaagcttagtaattggtcttcccatttgagatgatataatctccaagtcacagtacaaagttagaacatgaagggaaatggacaggaccctgtccccagacaccgtccatggcatctgtggctggtccccagagccagtgaaagggaggtaggtgcttggaccagtgctcccaggtggctgtccccggaccccttcagggtcctcctggtggccagggcccctgcggacagtttgagcagtaactaagctcaggggcgctggtaagagctgaattttatccctgaaaaactcatatgtttaagttttatcccctagcacctcagaatgtgacctcatttggaaatagggtgattatagatgtaattagttgagatgaggtcattagggtgggcccgaatccagtacatctggtgtccttccaaaaagggacgatttggacacacagacacacagcagggagaatgccgtgtgaaggcagcagaggtcaggctgctgtttctgcaagccacagaataccaaagacagtcaatgaaccaccagaagctacggaggcctgggacagtctccctccagtcctcagaaggaagaaaaccttctgacaccctgaccttgaacctccagcctccagaactgtgaaacagtaattttctgttgcttaagcctccaatgtgtgttactttgtaaacattatgtaaattcccaataaccagccaggttgtcatcagtactaacctttgaactcacgtgaacgagactcttcttaaacttctgagaggtgacagcgtgctggcagcccccacagccctcgctcgctctgggcacctccttggcctcggcgctcactctggccacacttgaggagcccttcagcccaccgctgcactgtgggagcccctttctgggctggccaaggccggagctggctccctcggcttgaggggaggtgtggagggagaggccacgggcgggaaccatggctgcgcagggcgcttgcgggccagtgcaagttccgggtgggcgtgggctccgtcggcccctcaggccccccactctgagcggccggccggccccagcgggccggggcagtgagaggcttagcaccctggccagcagctgtggagggtgcactgggttccccaacagtgccggcccaccagcgctgcgctcaatttctggctgggccttagctgcctcccctccgggcagggctccggacctgcagcctgtcatgcctgagcctcccctccccgccccccacgccctgccgtgggctcctgcacggcctgagcctccccgaggagcgctgccccctgctccgcgccgcccagtcccatagactgtccaagggctgaggagtgcgggcacaaggtgcaggactggcaggcagctccacctgcggcccgggtgcgggatccagtgggtgaagccagctgggctcctgagtctggtggggacttggataatctttatgtctagctaagggattgtaaatacaccaatcagcactctgtatctagctcaaggtttgtaaatgcacgaattagcaccctgtgtctagctcaatgtttgtaaatgcaccaatcagcactctgtgtctagctgatctggtggggacttggagaacatttatgtctagctaagggattgtaaatacaccaatcagcactctgtatctagctcaaggtttgtaaatgtaccaatcagtgctctgtgtctggctaatctagtggggacttggagaacttttgtgtctacctcaaggattgtaaatgcaccaatcagcaccctgtcaaaacggaccaatcagctctctgtaaaacagaccaatcagctctctgtaaaatggaccaatcagcaggatgtgggtggggccagttaagggaataaaagcaggctgcccaagccagcaggggcaacctgctcacatccccttccacgcagtggaagctgtgttctttagctccgcaataaatcttgctgctgctcagtttctgggtctacgctgcctttatgagatgtaacactcactgcaaaggtctgcagcttcactcctgaagccagcgagaccgtgaacccactggaagaaacaactccagacgcgcgccttaagagctgtaacactcactgcgaatgtctgtagcttcattcctgaagccagcgagaccatgaacccacaagaaggaagaaacttcgaacacatctgaacatcagaaggagcaaactccggacacgctgactttaagaactgtaacactccccacgagtgtccacggcttcattcttgaagtcagtgagaccaagaacccaccaattctggacacacttccagcacattctttttgtttcagctactttgccaagccagctgctcttcttatattgtgaatcttctcatttcattttctacaacattaatttatatttcagctaaggtactatggtgcctgaacgccaaataaaaagaaaaatgagtgatcccgaaatataacattttgttgatgtgaggtcataggtttacaaagcattctgatttagagaatcaaaaggaaaaattacagaaaacaaggaagtgagggaaaatgtaaggaaattataaatggatggcttcttcacccactgatcctcattaaaaaggaaaattgagctgccgtcgattgatggttctgttaaaattcaaaacagtggttctcaaactatagcccccagacctatgtggtctgggagaggttctcaaagtgtggtccccaaattcctctggcttcgtcatctgcacctgcacatcatccatctttccccaaccattctctcaagaaagccatttccatcaatagccaattctcgggcttctccccaacccaactaaatcagcacagtgggatgctgtatctgtgttagaacaagtcttctgggtgcttccactaaatgagagaaacactcctcaaatccaggaggcaacttgattccacctgacagcaaattcagcgaagagtcactgccccagggtactatgttcaaaaggattctgaagcagattttaaaatgaagaatctcttgggcaagaaagagaagggaaccgtggctggcaaaccacctatcagtgatctgggagtctcaagctcacaaaccaacaccaatttttttttttttcatatcagtggttccaaataaatgagtgcttccaaagtgctaagtgccatcttagcaaataaaaatctcccaaatttctgaagtgacttggaccctaggtatactgacataaaagtgaaaagaataaaaaagtttgctttcagttctaagacaaaacttgaaataagaacatggtggccaggcacggtggctcacgcctgtaatcccagcactttgggaggccgaggcaggcagatcacgaggtcaggagatcgagaccatcctggctaacccggtgaaaccccatctctgctaaaaaaaatacaaaaaattagctgggcatggtgtcgagcgcctgtagtcccagctactcaggaggctgaggcaggagaatggcgtgaacccgggaggcggagcttgcagtgagccgagattgccactgcactccagcctgggcgacagagcgagactccgttaaaaaaaaaaaaaaaaggaacatggtagcactgctctttcttccactaaacagatattgctccctctcctccccgtacctggctctctttcaggatggtgctattgtagtgatgagatacaggaatttgagctgggcttcgcctaattcaagaaaacaagcaacacacaagacttaaacttagaagataattgaattttcaagttactgtttacgttacactatatgatgaaggtttctcttcacttttaaaaggattttaagagttctttaaaagactatgttcccctgagacatttcatacctgatttgatttatttaactatcactttccacctgagcccctggaagccaagggcggtagctgagtctgcccatcctccagtcccttcttcctcccagcccccaccaactctacctgccggatgatgtggaacctgtcagcatatctctttttttgtggttttttggcttgattgaagtatatcaaatagaaactatatacattgaaagagtacctaccacttgatgtcttgatgcacatacccattgtgaaataatcaccacaatcaggctaactaacatatcaatcaactcacagagttaccattttgaggggtgtgtgtttgtgtgtgtgattgtgtgtgtgagtcgagaatacttaagaagctgttccgtgctaagtgcgtgccttcttagcaaatctcaagtatttcagcattgttaactatagtcacgtgctgtaccttagatctccagaacttattcatcctgaattgaaactttgtaccctttgagcaacatctccccatttcccctcctcccagcccctgcaaccacccttccactctcagcttctatgagtttcactattttagctcccacatgtaagtgagatcatgcagtatttctttccgtgcctgctttattgcacttaacctaatgcccttcagattcatccatgttgtcatggcagtatttcccttttttaaaagactggataatattctgttgtgtatacatactacatttcttttattgagacaaactctcaccctgtcacccaggctggagtgcagtggcgggatctcggctcactgcgacctccgccacccaggttcaagtgatattcctgcctcagcttcccaagtagctgggattacaggcatgcaccaccacgcccagctaatttttgtatttttactagagacagagtttctccatgttggccaggctggtctcgaactcctggcctcaagcgatctgcccacctcagcctcccaaagtgctgtgattacaggcctgagccaccccacccagccatactacattttctgtatccattcatccatcggtggacatttagattgtttcgacatttgaaagtgccttcctttgtccctgcctctgcttctcctgttgccacagatattcccatcctctgtgccctgctgtgtcccttcacctttccaaatcctttcctgttcaatccagacttggatggaggggccccttctctgaacttccagtaactttccagggtcagatgtcacttgccctgaagtcatatactttgccctatggctttgttatttgcacctgcacatccatctttccccaaccacactctccagaatgccatttccatcatatgccccacagcagtaatgcaatgattcaacagattcatttcatgaatagattcattctcaggggattgcatcaagtaagttcctctcatattccttttgggagctttgcatacatatatcagtctccaattgaaataagtgaatttcttaccttttaagggtcattgctggcctcagggaagcactcagagtgatcaggctaccagataatcgacatgattatttggagaggttatgtgacgtgcacagactagaaagctagaaaatccaattctgtcactcatctgcccctaatgaattgtgaggtctggggtattgtggttcttctctggcctgtgctttgaccacagtttctctcgattcttagtagtaaaccacatgatgatcagctaaaacagcttaaagcatcagcaacgtcagcatgttctgaacagtattattaatgctttgccctgtcctcctaaaatattcctctgatccttatattttctagtacaaatgacaggaggcatctctatcttatttatagctctaaataaattggtatgagcatcaaccaaacatatttattttatttcccaagaaatacaccaccagaaaatgtcaaggaaatgatctttgaaaaatgcacatctgaatgcaatatgaaatatttaagggaatcgctgtgcttttggcttccattttctgttagattattctacaggctcttgtaaaagtcaagtcagtgcttttaaaggcagaatgtggctgcaagttaagaaaagccttcaaagccctgggttcttgatttcccttttactttcagcattttgccttgaatgaacgacctcaaataacttagatattcaaaaattgatgaatggcacttagcaaggtacaactcaaataaagatgatgagaactaagtcagccaccagtggcctgaaaattcatggcagcagcatgcttcctgtggaggcatctcttcgtgacattttcaaagggttcttcccatccatccactttcccaaaatcctctgcaatttaaggaatatctcccacactggcctgtggtgttaaaccagcaaatcatgttgggtgagcaaaaagaactcaagaatagaagcttactctttaaatatccccctaaatccattcaattgagttggctgggaagcaaatactcacatagattaatgcatttaatcctccaacaactctgtaaggcaacgactattttacccccattccaagataaataaatggaagcacagagagttggaataatttgctcagcagtcacacagccaggaagtggccaagccagaatgggactcagctggccccagggcctggggtgtccaggccccatgctacactgtccccaccaacatgttcactccacatgtgctgatattggtctcgcacatgatgagttacatgaaaattttggtgaactgaaggttatcaaattcattagtaaattgcattggtacaaatggctgtggcctagggaagaagggtaaagcccataagaaatgaagacttgctcaggatctataaaagtaaccccaggaaaacatggcaagaccaaatcctgttgtctaagcaggcaagggaggcctctacagacaaacctgaagaaagatccactgctcaggcagcaccttatcacagctctgggatggccagtcgggggccgctatggaggacaagcctggacaacagttttggacagctgtagatagtctaaatccaacatacatatagccacctcgacagactgtctctggttagctgggtaactgaggctcctatgccaagaccttccacactggcttcttatcactggaccattgaagtcaatatctctgcactcactagctactgaccttgagaaaatttagtaactttttggggccccagtttccttatctgaaagatgaggctaagaagacagctccactggattattatgaggagtagatgagacaacccagaaaaggtgtcttattagcataaagtacttggaacagtgatgtgccccacataacagctgctgctgttagcactgaggtcacctacagcagcaaagggagctgcaatcataggctccactccccctttgccatcttttgttaactgccttgtctagacttcacttttaaatactccagatatacagtgccatatgaagtgtgctgcaggtgtcctcactgagaattcagagcccatagtagaccctgaagttctattcaggagcccagacgtggggcagctactatgagcactcttgttattaaaaaagctctgttgaatatcaaaaatggtttgatatcagaaacaccagaaatgagctataattggtgacattaaaagtattcaaaccatatggtttcttagtccatttcagcttctataacaacctaccttagactgggtaatttataaacaacagaaatttattgctcacagttctagaggctgggaagttcaagatcaagatgctggcagattcagtgtctggcgagggcctgtctggcataatcggtggcttgttgctgcagaaaaggtcaaatagctccctcaagcctcttttatgagagcatccatcccatccatgaaagctccaccctcaggacctcatcacctcccaatggccccacctgttactactactgcattggagatcaggtttcaacatgttaattttggggagaggacatcaacattcaaaccatagcataaggattggttaaaatattcaagaaatcttctctaccctttgcaagaagtatctaataatgcccagacccttttccttggtggagatgtgttatatagccttataaaatagcctaataggctattacataaggactttaggtccttaaattcggaggatctcgtatgcctgatgccagctctaggggtgacagaatctgtttccacagccttggcactgccttctggctccctctcctcagtggaactctgagcacctaagagacagggacctggacttcattaagcttacagcacaggttgatgagcactttggggcctgccagcaaattaatgttcctttaataaatgttttgtgtgagctgaagctgctttgagagttgctgtcacaaaaattgaggagcaaagagtcaagggatgagccaggtttcacctgcttcaaacttccttagctacttcttgaacctatcaaaaagaaaccaagaggtgtatgtgaccaaattggcttgggtacgtgaccaattgactttttcagtgtgcctgtgccataagcttcaaaaaggaagatgcaaggcaagtttcctctgcttagtagcctctcagggtaaagagagctgtagctacccccacggattagcaggcaaaagccaccaaggtcaggagatcatagtcaaggtcataccatgaggaggtggacaggacgagaaaagattcaagtaagtagttgtttctccctggttgccgtgaacattaagcggccaacttgaaataagctctttttctctccccacagcaaatataatccaaaatccccgttagaggcaaatacgagtatctgaattcagatttccaggtccccggcttggagaagggcagcatgggtctttatcagaatccagcttcgggatttcctggactttaaggatgcttgcttcaaccaaatgccctgggtggcccctttatattgaagaacccgtctttgactccatcctgacctgctctccttatactgggaagtgtgcgtataaacgtaccatttcatgaaaatagcatgtgtcaccaaatgagggttccagagagtcagcagcgtgcattcatccaagaacattggcctgagaaaccctggccaccatctgccagaaacttgagaccaagagctcatggaaaacagaaactgctgctctgttcagcctctgtaaagtgctcagtggtgccaatggttcagcaggctcagaagactatgacatggggtggggacacaggtgaggacatctctgtcatttgaacaaatttccaaatcccaaatcctgagcagaagtgcagagctgaatgtgcataatgtgcatgtcagttgatcggggaaaatgcacttcctctatttagattctctgaaaatgacctcaaaagacatgagcttagttacagctcagcgatgctcgttgccacaacaagaaagcccagactcagtgcagcagcttaacagcaaaaaggtctctttgttcatggagtccggtgggccatcagtgctcctacatcctgcagccatatgtaccatctggggcaagtgtcaggtgaggttgccacagccagagaagagaggacaagagggtcactcgggatggttttaagagctgggcttaatcacttttgcccacacctctggccagccccatcactcatcctgcctggaaggaagcctgggaaatgtgggggatgccacaggtaagcggggaacccacaggtaagcaggaagatgttatagtgtctaccccaagaggtaagccactctggatgtgatgtgtgtacaggacctatcacaaagccctgagccccaaatcctcctccctgctcacatcctcacctgccacagattccttctctgtaggataagagacatttgggaattcatgatactccttctggactagacatgccacctggaatggatgaaacctgttttcataattaataccatttcaaggtgctggcatgtgagcaggaatgataaaactctagaaattcttcatgaccgatgtcagagtccaggaggtacaggtgagttacgaaaaccaagaagaggtagattgagaaccgaaaatgagtatgagcccaagtcagggtcaagaaaaggaatgagctgctaagccctcggggtggcagcaggtggtggagagatggcaagaagctgtgggaggtgagcacagggccagaagcagggaagaagcaatcgaagagagaagcagcacaaggtggccagaggcacaggaagaaggggctgcctgctgatctgagcagaggtccttgagtatcattactgaggacccaatggaggactccggaggaccatgggtgaatgggaggtgagggaggcaggggaaggggctacttgtgcctccaaccagaaattgagagacccccaagtatgtgggctctactcgaactcctctgacctcccacaagctgagccctgcccccccacaagctgagccctgcccccccacaagctgagccctgcccccccacaagctgagccctgccccccgaggccaattcctaagcctgttcacaccccactgccttcgctggcctccatgaatttcacccttttttggcccaaaagaaaaataataataatttaccagaatcctccttcttagctagttcctgggctcatagttctggcctggtcctctctctgttctggtatcatccacaacctgccataagagtgaggtttattttatttatttgtttatttatttatttatatttgactgcctagggtatgggtcttaagcccgacctttccaaacatgttcctttcctcagtccaggatcttaaatctttcttaaaccacttcaagaaagtggtctgtttcctcttctgcctatattactatacatattaaagacagtcctgattctcagcatgagaacatttatctctataggtcactttttcaaaaaggttaaagcaattgaaaaaagccttttccttgatatcaaagccatagacttagatgattttttaagcctaagaaagccctctctaaaaaaaaaattaaaaatacaaaagaagaatttcctaaaaagaaaaatacctgctgatttttcttagcccagaaaattattagttcacaaggtgaatttccccgtgaataaactcaaacgtggatggggaaataaatcatttgactatccacaatttttctttgtaaccgtcatcttgttgaaaaaggccattattttttgtgctaacggaagtgccttgctaggtaaaatgtatacactatctcaaatgtatagaaagattcatctttccagtgcatttacttctgttagctaataaattccggcagaagtgctacaaattacattacaggtataaataccagcatgtcagtggtgtgattattaagacacctgacttgagttcacccttcaatgaccttgacattatcttggtccctcttgcctgcatatactgcgccaaatgaaccaccagggatgggccattccttgataaacacatgtcccagagtttctatatttttttcccctacactacatgtttttaaaaatgtttttttaaagctgtcctcttttattttggaaaatatgtccatcagagctatagccagatctggtatcagctctccctgcctgcagccattccactgggcacatgcccattgctataccagctgttaagtggcttgaacagacctccggctacagctgctttagcactcatttccacacacaccctctgctcccctcttctccttgatcccctccagcctggcttccacatccaatgctccatttggactgctcattcaagatcagcagggaccttcatgtcctcacaggcatggaaggtttggagtcattatcctgaacaacagccagcggtaggacagtgcatctcactccctctttctccaagttactcttattttctcggatgccaccttcctctggtttggcttctgccactccagcccctcctctgggagctcctcccgcaaacctgtccttgaacgttttgtttctcagagctcttctcttctgcctcccctacacagccttatcaactgtgactctcagaggatcatctcttggggtcagtcaacaaatctgagtgaatgtccctcaggaagctcaaactctatgagtccaaaatggaactcgacatcattctgcaatattattcatgttattccagctgctactgaagaagagagcgccctgtctagtgcaccctggaaatggtacccaaaatgtttggcttgctcaggcaaaaatgtgaacatcttccttgccacctccctcctatttcacttcaagtaagtgccctgcatctgcctcttcagcatatgggtttgctttggccactcccatcctcaccacactgctccgaaggcctctcttgcccctcccagcccatcagcctcaatgacctccatgccctagttcattctcctccaatctcacctcaacactgcagctggactgaacttcccagaacttaaatctgatctgtcactccactgctttaagactttcaaatgagtcttcgatattttttagggtctttaggatgaaatctgaactcttaactaactcaggcactcccagtggaggagcctgtgtacttctgtagcctcgtctctctgctcttctcctggcatcctctgatgggcaggaccacgccccactaccctctcgctgtctccaaattttacacaagctgctccatctgcctcgaaacaatgccgctgcctctgcgccccctctcctgacacccactcattcaggtgcacccatgggaccagctcccactacccctccagttgtggttgaagaaatatttcgctttgggagaagtttcctgacctcatggctgagatgggtcttcctgtggtgggttcccttggcacctttgctcccccatcaacataatcatcataccttaatttttttcctgaattgtatttttttttcccgctaaaccttaagaactactttggccacagagctactttgattcattccctgctatatctccaggacaaaacagacactgggtaagagtaggcactaaataaatattgaacaaatagaagaaggaatgaatgaaaagggaaattaaacctcacctcctccataaagcccgacccattacttccgcccacacgagggtctctccagcctagcactatcagtattttgagcaggacaattgtttattttggaaggctgtcctgtacatcataggatgtttaacagcatccttaaataccagtagtacaagcctccctgcaagttgtgacagtcagaagtatttccagatggtgagccatgagatgtgagaaccattggccctcactggcccccctcccttctctgaccctcttcactgccccttgcagtcatcaccatctgttatcacatggtttttctttgccagggccatgtacaagtagtcttgtcaccccaaaaggaggaaatcctccttgaaaacagggctctgtcctcttggcatcccgtgtaacagctcatgcaggactgattgtagcaaacaggattggcctgtgtggccctccgtggaaagggggaacaccaacgtggccacattgtacgtgaaattctgactctctaggctaagtctgtcctttctgtacaaatatccttaacatctcaacattggaaaacagccttattgcaagctgctactgaattcttgatcgcatacagtgctgttctgtgtgcttcgtaaagaggatttaaaacattgcagagtgaataatctcttcatctggaattcattaaactctcattttctaaaaattcaacaacgtcagctgaacccatagcaagctgcccatgcctcagtggtcacttgcttggaatgccgcttcctcccggtaactcagtttcaccgcctggcacattcaggacataaccgaaggaactggagccaatttgcccttgaccctgtagcatgacatttgacttcccttaaactatcttagatgtctcctgtgctctttaaataaattatgatgataattaatatcagccaaaaaaatcaatggttaaaaattaattatttatattaaatatttagcaagtattcatatactaaaggtgatttagcactgtagtagtccttaaaaacaatccaaacatgccatttcctatcattagaaaattacatttgtatttagaaaatcatcttgataaataaatgtgcacacagtaaaaacgggaaaaaaaacacagtttaccttcatcgtgtgcatattctcaaatctacaataagtcagtaagttcaacaaagccttttctgtgagttcagccatgcagaaagaacacctctcaaagttgtgactctgctctgagcctgtttctgccacagtcaccctgtgagcttgagaacattttcctatacatctccctgggcctcagtttactcatgtttaaaatggggagaaagggccaggcgcaatggctcacgcctgtaatcccagcactttgggaggccaaggcaggaggatcacttgagcccaggagttcaagaccagcctgggcaacatagggagactccatctctacaaaaaataattatttttaaaaaattagctggacatggtggtgcatgcctgtggtcccagccactcgggaagttgaggcaggaggatcacttgagccaaagagttgaagctacagtgatccatgatgtgccactgcactccagccaggtaacagagcaagaccctgtctctgaaaataaataaataaaattaaaaaaaaaataaactgaggacaaaaattccacatgaaaacccaaggtcccttttggaactaaaatttcatagttttgagcaaatcccatgacactcttatttatccccaaattgacttttctgttccttattaattgacaagtgacaaaattggtaaaatcatatctacactgtcctggaattaaatggcacaaaagagaaatccatcattttggcatagggacaagtttcctggactcagaagttagcaacgaggggcttacatagaaatatttacatagcagaaagctccagatcagcagacttaaaagaaaatatgcagacattcagaaataaaggacgatagaaaataaggttgcaagatggaagtaagctattgtgaatagtgctgcaataaacatacgtgtgcatgtgtctttacagcagcatgatttatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagtacctgttgtttcctgactttttaatgattaatgggtgcagcacaccagcatggcacaggcatacatatgtaactaacctgcatattgtgcacatgtaccctaaaacttaaagtataataataataaaattaaaaaaaaaaagatggaagtaagcaataactgtgaaactcagagaacacatccccaagaaaggacctggcaccatctttgttgttctctttgatgtggttgttccaaattcaggaattcactttggtaaactttctcttggagggtttcctccctttcccagctctctccaatgagcatggaaaatgaccacggacaaacctgagcgtagtatgtattatagaagcaagaagtagaaaatgcactaatgagccaaccagtggatcaactccacatttctacagttattaaggcagtgacatcagtcaaggctcatttacaggaagcagaaactagtctagctattttaagcagaacaagacaaggcagggaactaagtacctataaaattgtcagaaggtttggaagagtgagctgggcctccaggaataactcccggaaccaggggccaaactgaccctcggaggccagttagaaatacaggagttaaaagtgcagccctagtacaactcgccacagggaatattggctcctcctgcgccaagctggggacagaaatcacaatactgagttcctctgccttcaaacgagcgatgcccaaacactgcaccggctgccaacactgctgtgaagtctgcaccatccagcagctaaaccctgtcatctccatgaccctacttgacagcagcaacagccaaagcacaagaatgagtgtccctctgaacctgcacttccaaatctcagcaagccgcctctgaaggctggaacccaattcacattcataaccagagttgcaagggagactggcaatgtgatggtttgcctccagactctgcggtaaaggaaagctcattctgtaatggaaagaagctggaattcacattgagttccagtccaccatatccaccagagttgagatggaagacgcaagtaaagtcccccataagatcctaaaagcagtcacaaagctactgtccaacaaatctcaactgagttataagacttctccaggtcgacttttatcactttacctcaaggaagacataacattttgggatcaatattttatagatttgcatatgctataaaagtcttagctcttatatactccctgtacaatgtttaagtgattttccataagatgaagaggtaataaaatagaaggaagtctgtgactttattcactcacttatacatttaccagcctgctataaatattagacccaggtgctggaccagacatggagatgccaaggagaaggagtcatgggttaagatcactcgctttagcaggaatcatttccagtacaagtcccatttctgccacttaccagctatgctaccttgggcaagttcttaatctgttctatgactcagtttatccacttatcaggtgagaataatgatacactctttaggaggctgtcacccaagggttaactgagataatatgtattacttttagtatagtgatttgaccatatattagtcagggtttgcagagaaacagaaccaatagactatgtgtataaatatatatacagagagatttattttaaagaactagataatacaattgtgggagctggctagtccaacatctgcaggatagggtgggaggctggagacccaggaaagagctgatcttgcagcttgagtcgaaggcagtctggtgacagattccctcctcctctgggaggtctgtcttttctcaagatcttcagctgattggatgaagctcatccacattatggagggcaatctgctttaatctaggcctactgatttaaacgttaatcgcatccaaaaaacagctttaccgcaacatccagacttatttgatcacatatctgggtaccatggcccagtcaagttgacacagaaaattaaccttcagagtccattaggagcattcagaaaatgatgctgttgtgattaagctataatcaaagacttgaaggagtttgcatctagtggtaaagatagataatcacagtgccatgtgatcagttctatgaaacagatgtttgggagaccatgggtacaggcaacagggtgtatgtagaaaaaagaatgccagggagggctctgagaggtaggaaagaaggcttatgttgcaggctctgggatggcctctgccgatgcagatgtctcaagagtaagaagaaaatcctatgtggacaccagaaagaccagagatgtccagttccccctcaccaggcctaagcacgttagggttcagtgaaaatatcttccttaaattgggagggtcccccaccggtctaggtgggggtgagtattcaaggtagccacaggcagcagaggtggggatgaagagtcagagtcatggtcaggaggtggtgaggtcatggtggggaaaaaaagcagggcattaagcccaagggaaagaacagacaccagacctcaagcttccagtcaggagatgggacagtcaacatggaaaataaggagtgaggacaggagaagggaaagcttagaattcaactgcaaacgcaagcttgtgcaaaacactgccccgcccccactcctccgcatttacagccatggcatttatagccaggtagcactagagcagcagtggactataagggaccatgtggaaagggacaagtggaatcacaagcccctggtgccaacaaatgattgaccattgttggtactagagctttgacccctgaaagaatccatttgcctgtgcaccatggaggcacaaagtccagaagccaacggccttgtcatgacgctttcccaaagagccatcctttcctagccgcctcgacccacaacacccaaggggtacagatgtcctcatctccagtcatttaccccagcctggtccattcccagtgaggttaaggttcacatttaagccaaaatttccagatgcatttcttatatccttgagccgtaaaaattgagtgcttggtccaggttacatcctgggtgctcagaatgttttgctgccaaccatttggcccaagtctcaaaggcgttcctccagagtggagatgctaataggttttgagcgagtgaaaaacatttgacaacaaactgaaacttgaacatattgatatctccatcactgacagcaagagccggagagagacaagcgggattcatcttgattggcgtgtggcaacaatagtgcatagcctccaagttctcccggagccatgtgtgctgccaattgtaaaagggagaaggatgacaagtggacggagtcctttgagattgttttccaacataaactgataaaaaggcccactgggcattgatgttagaaagactcaagatagttaaacctaaaaaaagagtctaatgcaaaatcttttacctgacgtctcctatattttttacccttctgcaaattttaggtgggtacgtgaatcatttaaagccatttctgtcttttctaaacttccaattataccacccacagcaccaaatggaaggggaattgtaatcaattttttaactaaattcatgtaaaataaaattagacccaaaggatctgaataacaaagccattttattcaaccaagaaatcagattttgacagccaaggttttttttttaaaatcgaatctattttccagagaatttattcaaaatgctcaccagataccaccaggcactgtaacagaactacaactaacccactgttctcatatgggtcatatttgtaatgggaaataacacattagatagatggtgacatgggttattctcccagcgtgggcaccaaggagctgtacatcctgagaaagtcacttcatctctaagctttgtttctgtacctgtgaaataaggtgctaaagttgatgcaacgatgacccaattctttacccctcttatatgctcaccctttaacaagtaacttactaatgccccccactctgaccctaggctcagccacatgatttcggtcaatagaatacaacagaaacaatgccccagttcccagcctaggctgagtccttgcaggtttctacttactttcttgagcctctgccattgccatgggaaagacaaccctggtccagctccctgagtcctgagaaggaagagagacaggtagagcaaagatgagtctcccagctgagactctccagccaaatccagtcaactctcattccacatcagcaaatgcagcagagatcagtagagccacccagctaagccatccatgaaaataaataactcaggatggattgttatacaacaaaacctaagttgcacaggacaatacaacccactccaactatcttactagcgtgttgggaagatcaactgcaaatatatatatatataatgcgtatatatatgtatatatatgcatacatatatacatatatgtatacatatatatacatacatatatgtatacatatatatgtgtatatatacacatacatacactcgaaagactgcaaatctgcctcccagccataaggaagaccacatgctctgtaacccatatgccctattcctgcatcttgagcggtctttccaggtggaccctccattctgaaattaacttccttggaggctcaatttctatatgacaccttataaatatattctgcctttctgctcagtccctttagattctggtagacagcatgcttcactcattcttctaacccaccccatctctttcccaaccaaaaaaaagaaattttttaacatctcccttggcttcatgttctgcggaatctagggccagacagtcctcctcctcctgaatccacctgcttcctgtaccctcatcggttattctccagtcatgacttaatctgggaggggactcaaacatatggtatatcattattacaaaaggtcacagcaaaattaactttatgccagagaaactgtttattctactaattgtcacttagatggcttattgaatattgggtagcttagtaaacaaaccctttcccaaggctacttaaatgtatgcttcttcttgctttgtgctgggttaaatggaaccatagttagcagagtagagagttgctttccttcagggtgggctcagaacatgcctggaatgctaccttccctggcacccaatttggagacaggtaagggaaggctaacggctgtcctggggtaaatgctgtgcccttcattggtaaattgtaggggtccatgccctgactagcgagggacacctgaaggaaaactggcacccaaggcacagccaccagcatagaaaccaagaaggttgttgtgggaaggagcagcatatcctaccacagttactgaccacagcctgacctgctgccaactgaagcacgggagaaacggaatatccaagcagcactggcacagctgattatctctccttactcagcctgtctccaggatacaggagtggagctgtggtcaatggacagcttgaaaaatagatgatctctgtcctagatccttggctacggggccaaatacttattaccccaagaggtaatacgcaagcccacctaaaataagccaagcaatacctgtgaaagaccattggtacctgtgggtgtcattagataatatggagactaggaacatgaaccctgaagtagcaaaaaaggaatcaaaaggaacagctgacaaaggaacaaagacccaggacccacaagaaaggcagaatttcttccagtaaaggaaaatactctaagtgcttttaagactttttaattatcagttcacaggcatctgctgaatgcctgttacaggcccatcacaaaggctaggaggaatacaaagaaaatcaagatatactatctgcctcagaagattataaaactggtgtaaaatttcttactaaagcacaagaaacaatagctaagaataacacaacgcaatataattatacgtcagttgttctcaatttcctgtgcaattgagaatcacttaggaggcttgttaaatgtgtattatatatattttatatatatatatatgagatatatatatacgtgaaacatatatatgtcatatatatgtgtgtgtgtgtgtgtatatatatatattactgaagccaaagtgcaccaaacctcatacatcaggatctgcaggagctgcctagggaccacgatgcacacctggttaggggaccctgggatgcacacagtgctctgagaattcagaggagatggagtcaatggaacatcctggactacttggaaacagcagctactctagacatcagtgctgctcccacagggagaagactgactcccaaatccagcaaggaaatgctggatcatgggcctggcacactaggtgttacattttaagataatgctaaaattacttaactcctgttttccaaggctggccttgagactttcagaagatgatgttcacgcaatttgcccatggctcaaagtaacaaggtgtcagatcactaacaagtgatctgaaagctccctatcagctcagaaagaacgacattcctaaaaagcattcaactatttcaaactattgcttaaggctacctggtggactttgtgctgtcaaagatcccttccacctcaaatagaaagctccccaaaatacatttctcttctggtaagttattatcaataggtgggacctgagcagtctgatatctttctggccttgtatgagtcactgtgcagaagtacagattaaactaaatgatgaaagcttttatcagatgataaatgggatctcaaataagtactcagacaatacaactgtacaatggaaaatccatactttagtgtcctaaaagaggcatggcactctgcttcaaatgtatttttaaaataggcattcaccaaacaaatgctgagtgtcccctgtgcttagcacagtatcaggtgcaggggacacagtggagagcaaccagacaaggtcttgccctgtggtccagcgacctagtaaatggaaccccacccaagttctgaatgaggagggaggagtgccactggaaagatgatgtgaaaatcatcccagaaactgagatctttcaaatccaggacacctccatcatttcactgtctatgccatcttcctttttcctcccaaattactttccagaatagttgccctcacccgcacctctcgccagcaggacacaaagagttccccatgttcaagtcaatgctgatgttttccaacttcaaaatgtctgacagtttgttgattatcttgacttaattggcatgtctctgattgctaatgagattgagcatctttccatatcctgacaagcatttggctttcccccctgcaaatttcctactcatgtcctttgcctgtagttctattggtttcctgcctttttatattatagaagctaatcctttcttggttgtgtgacttacaaataccttctcccagggtattagtgctggctgtggtgtccagggtaggtactcactgcccctaccggaaggaggattacacacacacctgacccattgatgagaagcttgaccatgtgacttgctttggtcattaaaatgtaagcggaagtgatgtgattttttttttttaaggaaaagtgttaagggccattttataaaaccaccgtgtaatttaattcagagagagcctgctctttcagcctgaatcctggaatagagacccatggagcagacccatggccaggccacagccacctcagcagaactcagcctttattaccataagccatggaaattttggtgttttttgttaccacagagaagctgaacaattgaaagacatactggaagtgaggtgccaacactaataaaacacatgataggatttagggctgagtagcaggtggcaagaaaattgatattaaaggctttttatgtagtggtgaagcatttgaaaaaaactattgcctgtgataactagaaggcaaaaaatgtaactaataaacttctggtttcagcaaagaaatgggaaaacagactgtggataacattggatatttgctaatggctgcatttgacaagacgcagtaagaaagcaataagctcacaaaagaaatggccattttgcaagaggaattcaaagagagttcagagaggccataaatttcaggacttgcagggttagaaaatggaactgtttctcatctccaattggcaaaagataaaactgagaagaccttgagctatgaagtccaattaagattcatccttggggcaaagataaagtcaagtagccttgtcagcccattgttagagctctaattgggcagaaagcgggagaggagatgaagtattgtaagtgaactaactccgccattcagaaaaggtggaaatatttgatgtcttaaaattagtaattccataaatagcaacataagcatagtattcagaaatatggaggtgtaattgtttcccactgctgtgtaacaaataccacaaacttagctgcttaaagcaacatgtgcttactacctcacagtttccatggtcagggacttggcatgggttaactggctctttgactcaggatcacatcaggctaaatcgaggggtcagccaggcctgtgatcccatctgacacttggggtcttcttccaaattcacttcttgttggcaaaatatagttcttttacagtggtagaactgaggccctcagctcccaggaactacccaccactccctgtcatgtggtcctctccacaaaatggcattttgttttctaaagactggtagagaggatctctgttgctttgaatatctctggcttcccctgtctcttatctctagaccttcttttttttttttttttttgagacagagtcttactctgttgcccaggctggagtgcagtggcatgatctcggctcactgcaacctctgtcccccaggttcaagtgactctcatgcctcagccccccaagtagctgggattacaggcacgtgccaccacgcccagctaatttttgtatttttagtagagacagggtttcaccatggtggccaggctagtcttgaacttctggcctgaagcaatccaccctccttggccccccaaagtgctgggattacaggcgtgagccaccacaccaaatctagagcctctagaccctgtttgaaagggctcatctgattaggtcaggcccactcaggacaacctctttcaattaacttaaagtcaactgattaggaaccttaattacctctgcaaaatccctttaccttttctatataatgtaacttcatcacaaaagtgatatcccaatcacattggcaagtcccacccacactcaaagagaggggattagacaggcatgtccaccatgtagaggaaatcctggggccatcttagaattctgtctaccatggaggcagtcacagaataaaaattttaaagtgttttcctctgaggagtgaaactggtaaaggggagaggcagaagaagagcataatctgtacgatttggtttttaaaaccacctacaaatatcatcttgatagaaatttatcttaattttaataaggtattttatatagaccacaaaaaatagcatgagcaaagaaataaaaatgcactcaactttagaaagcaatcaaaacaaattttcccctacaaaacagactagctccatgaggcaagtaaaaactttttttaaatttctgattcatatttcaaaaacaggaaaagatacattctttaatcaaatgaaatgattctacatcagaaatattggtttcagatttaaaattacttgcaataaatttaaaatgcaacacagttaagaacagaagattagacactgtgatgaaccaaataagtcatttagaagattggtgtgggaaattataaaactcaggatatcagataaagagataagatttaccttaaatctacatataaaggaatctattgaatgaaagaacaaaacaaagtgcaaaatataatatgttatatcgcatggcaaaggtgaattggtgttgcagatgcaattaaggttgctacccagctgacttcaaaacagagaaattaacctggattatcctggtgggccaaatgtaatcgcaaaagtccttaaaagcagaagagggaggcagaagagggaggcagaagaggaaaatccagagagaagcatcagagaaatgcagagagcaaaaggaactcagcctgatttttctggctttgaagatagaggaaggggccatgaagcagggaatgtgagcagcatctagaagctggaaaaagcaatgagacagctcctctagagcctctggaaaggaatgcagcccttccaagaccttgaccttaacccacgaagatctgtgttgaactctaatggccagaattgtaaaataataagtttgcattgttttaagccactaagcttatgataattgatcacagcagcaatagaaaatataagggttaaacatattcaggtgattgacagttttatatttaaaggcaaagacaaagtcttacacccatttacttggggaaaaataatgacgcctacaaatgaaaagtgaaatcaggctggcattggatttatctcccatagcactcatggcagaggaaaatgaaatgttatccggttatggggaaggagaagtgaattatgatccaaaaatattaagtccaaaccatttgaagttagaagcaacaaaaagacactctcaggcatgcaggaaaagtataaagattacctatatattttctcagatttaaacaaatacacagagggaataatccagtcatccaataagtaagtaaaaatgcattcacttattcaacaaatatttattgggaacctctttctcaaaaaatagtattcagggatacagcagcagagatgtcaactgtctcagtaagatcacacaggtaaaatctcagttctcatggagtttatatgctaggtgggagagacaatctattaacaggcaaacgaataaacaaataatacaatatcagtttgtgataactgctaaaaaaaaaaagtgaaacaagacaagagtgacaagcctggaggaaaaatatttttgataggagtttcttagagtgtctttcaatgacatgattcttaagcagagaacttaagccactgaggaaataagccatataaaatgtagaataaaaaaattccagtgaagcaacaaaatctttgaggctgaaacaagcttactatgtttaatggagagcaaaatgttctatacgactgcttgggcttcctcactgtatgactgctaggttctaagaccaagcatcccaagagaaccatgtggacaccatattgccttttatagcctaaccttgaaattacatagtcttctgctgttgtcatgaatccacccacatttaagggggagggaacatacacccagttctgcataggagaagtgtcaaggacctactgtaaaaaaatcatgaggaacaggagctaattttggccatttggggaaaatacagttcgccacagcataccgaaacaaaatgacatatcaaggccaaaaaataaagcaatgagcaaagacatcacagaaaactataattaaaaaaatagtaaaagagatgatatggttgaaatagaatacatgaaaaaatttataattggacaaggaaagtccatttatatcaatgaaaggcaaaccttgcaataaaattgttggtttttgctgtataaccaaccatgccaaaatttagtagcttaaacaatagccatttatttagctcagtattctatgggttggcaatttgagttgagctcaactgggcagtcgtcatcacctcagctgggctcgttcttcatgtgtgatcagctgccatgactctgcaactgtggttggatgactaggccaacagggccagtggtggaaatgtggccacatggatctcatcatccagcctgctggccagtgcttgcctacccagccgctgcagtaggagtcccaagagcaatgaaagagcaagctccactaacaggtgcttttcaagcctatgcttctatcgtgtctgcacccatgaatgtttacaagttaagtaacttagcatcaaaataaaccactaaagctaacaaaagcacaagaagaaactgataaaaatcacaatgatagcttcatcttgagttcttaatctttagacaataagcaaataaagaattatggttcaaacaaataattaagtcaacaaatatccatttttttctgttaagaatatgcatcatttttcaacgtccttggaacatttacaaaagttgatcatacctttaggccttaaaagaaaatttttaaaggatgttagggggtttagaaaaaaagaaaatcttaataaatctaaaaaaattgaagttacataggccatattctgtctaaatgcaataaaactagaaattaacaaaattataagcaaaaaaattcaaatcattaggaaatgaaaatgccttcctagatatcttttgggtcctaattatggatgatttagaaaataaaataatcacaaaattatatgtcaaaaactatgaaatgctttatgttagggatcagcaaacttttccagtaaaggaagtacatattttagacttgtggaccataagaactgtcacactacccaattcatactgtgattatgtagaagtacacatacacaatacacaacacataaaggaatgggtgtagatgtgttccaataaaactttatttatcaaaacaggcagcaggctggatttgacccatagtcttggttttccaacctctacttatataatattaatcaagtgttaagcacttacaaatttctaactttacatgtgtttattactaaaaaaggaataaaaatcaatgaaatattaatggactctagaagctagaaaaaagtcatcagtagcaaaataaagaaagcaagaattaaaaaataatgaagtaaaacataaattaataaaataaaagatagaaaaataatgacattaataaataactccgatatttgaaaataccaataaaataaacaaaatcaaaacaaagcaaatcaagaaacatgaggggaaaagcacaaatacatatcattcagtattggaaaggaatagcaatgacagatgcagagaatttttaaaatcataagctatcaactaacactaaaaacaactgtattgtaataaatgtttaactctcaatgaagtagttaattgtctagacatgtcctattgactaaaattgcctcctaaaaagggagcaaatctgaacagatgaagcaagcataagaaaatggctagggggagaactcagcacaagatggccaaataggaacagctctggtctgcagctcccagcgagaccaacgcagaaggcgggtgatttctgcatttccaactgaggtacccagttcatctcattcggactggttagacagtgggtgcagcccatggagggcaagcagacgcagggcagggtgtcacctcacccaggaagtgcaaggggtcagggaactccctaccctagccaagggaagccacgaaggactgtgcagtgagggacggtgctatctagcccagatactacacttttcccacagtttttgcaaccagcagaccagaagactccctcaggtgcctacaccaccagggccctgggtttcaagcacaaaactgggcggtcatttgggcagacaccaagctagctgcaggagttccttttcacaccccagtggcacctggaaccccagcgagacagaactgttcactcctgtggaaaggaagctgaagccaaggagccaagtggtcttactcagcaggtcccacccccacagagaccagcaagctaagaccaactggaatgtaactctcgctgccagcacagcagtctaaagttgacctgggaccaccattactgaggcttgagtaggcggtttcaccctcacagtgtaaacaaatccacccacccagaaggacttgaactcagctctgggcccagaggacctaatagacatctacagaactctccaacccaaatcaacagaatatacattcttctcagcaccacatagcatttattctaaaattgaccacataattggaagtaaaacactcctcagcaaatgtaaaagaacagaaatcataacaatcaatgtaatcaaattagaactcagaattaagaaactcactcaaaaccacacgactacatggaaactgaacaacctgctcctgaatgactactgggtacataacaaaattaaggcagaaataaataagttctttgaaaccaatgagaacaaagacacaatgtaccagagtctctgggacacagctaaagcagtgtttagagggaaaattatagcactaaatgcccacatgagaaagcgggaaagatctaaaattgacacccaaacatcacaattaaaagaactagagaagcatgagcaaacaaattcgaaagctagcagaaggcaagaaataactaagatcagagcagaactgaagagacacgaaaacccttcaaaaaaatcaataaatccggttttttgaaaagattaacaaaatagatagaccactagccagactgataaagaagaaaagagagaagaatcaaatagacacaataaaaaattgataaagaggatatcatcactacaccagagtaatacaaactaccatcagagaatactataaatacctctatgcaaataaaccagaaaatctagaagaaatggataaattcctggacacatacaccctcccaagactaaaccgggaagaaatcaaatccctgaatagaccaataacaagttctgaaattgaggcagtaattcatagcctaccaaccaataaaagcccaggactagagggattcacagccaaattataccagaggtacaaagaagagctggtaccattccttctgaaactattccaaacaatagaaaaagagggactcgtccctaactcattttatgaggccagcatcatcctgataccaaaacctggcagagacacaacaaaaaaggaaaatttcaggccaatatccctgatgaacatcaatgcgaaagtcctcaataaaatactggcaaactgaatccagcagcacatcaaaaatcttatccaccacaatcaagttggcttcatccctgggatgcaaggctggttcaacatacgcacatcaataaacataatccatcacctaaacagaaccaactacaaaaaccacatgattacctcagtagatgcagaaaaggccttcaataaaattcaacacctcttcatgctaaaaaacactcaataaactgggtattgatggaacgtatctcaaaataataagagctatttatgacaaacccacagccaatatcatactgaatgggcaaaagctggaagcattccctgtgcaaaccagcacaagacaaggatgccctctctcaccattcctattcaacatagtatcggaagttctggccagggcaatcaggcaagagaaagaaataaagggcgttcaaataggaagagaggaagtcaaattatttctgtttgcagatgacatgattgtatatttagaaaaccccatcgtctcaccccaaaaactccttatgctgataaggaacttcagccaagtctcagcatacaaaatcaatgtgcaaaaatcacgagcattcctatacaccaataatagataaacagagagccaaattgtgagtgaacgcccattcataattgttacaaagaggataaaatacctaggaatccaacttacaagggttgtgaaggaactcttcaaggagaactacaaaccactactcagggaaataagagaggacacaagcaaatggaaaaacattccatgctcatggacaggaagaatcaatatcatgaaaatggccatattgcccaaagtaatatatagactcaatgctattcctatcaagctaccattgactttcttcacagaattagaaaaaactaccttaaatttcatatggaaccaaaaaagagcccatatagccaagaaaaccctaagcaaaaagaacaaagctggaggcatcacactacctgacttcaaactatactacaaggctacagtaacaaaaccagcatggtactggtaccaaaacagagatatcaaccaatggaacagaactgatgcctcagaaataacactacacatctacaaccatctaatctttgacaaacctgacaaaaacaagcaatgggggaaaggattccctatttaataaatggtgttgggaaaactggctagccatatgcagaaaactgaaactggaccccttccttacaccttacacaaaaattaactcaagatggagtaaagacttaaacgtaagacctaaaaccataaaaaccctagaagaaaatctaggcaataacattcaggacataggcattggcaaagacttcatgactaaaacaccaaagcaatggcaacaaaagtcaaaattgacaaatgggatctatttaaactaaacagtttttgcacagcaaaagaaactatcatcaaagtgaacaggcaacctacagaatgggagaaaaattttgcaatctacccatctgacaaagggctaatatccagaatttacaaagaacttaaataaatttacaagaaaaaaacaaccccatcaaaaagtgggtgaaggatatgaacagacacttctctaaagaagatatttatgtggccaacaaacatataaaaaaactcatcatcactggtcatttgagaaatgcaaatcaaaaccacaatgagataccatctcatgccagttaaaatggcaatcatgaaaaagtcaggaaccaacagatgatgtggagaaacaggaatgcttttacacttttggtgagagtgtaaattagttcaaccactgtggaagacagtgtggtgattcctcaaggatctagaaccagaaatatcatgacccaggaaccccattacagggtatacaaccaaaggattataaatcattctactataaagacacatgcacacttatgtttattgcaacactgtttacaatagcaaagacttggaaccaactcaaatgcccatcaatgatagactggataaagaaaatatggcacatatacaccatggaatactatgcagccataaaaaagaattagttcatgtcctttacagggacatggatgaagctggaaaccatcattctcagaaaactaacaaaggaacaaaaaaccaaacaccacatgttctcactcataagtgggagttaaacaatgagaatacatggacagagggaggggaacatcacacaccagggcctgtcggggggtggggggcaaggggagggatagcattaggagaaatacctgatgtacgtgaggggttgttgggtgcagcaaaccaccatggcacatgtataaacctgtaacaaacctgcacattttgcatatgtatctcagaacttacagtataattttaaaaatatgaaaaagaaaaaacaaaaaagaaaaaaagagaatgactaacatttgttcagcgcttgcaagtatcaggtattctctggctaactgaataccttgtattgtcacaatctgtccaacaaccttatgctgtgggcctattattatgcctatttgttcagataagaacacagatatttataaagattaagaagcttcctgtaatctagtaactgaagttggcacactttgacccaagcagtctaatgactctggaacctttatggcttagcattgcagaagaaattgaacagggtatcaaagagcaaccaccaaaatagatagtgggacaacatgatatccccagtgagctccctcaaactcttgagcaactgataattcctatgtaatttaaattatttcaggggaaaaaaaaaagataaaaagaagaaagtgttccattttattttaagaagcttaagccatctaaaattaaaacttgacaaagataactgcaaacttatctcacaaatatagacgcaaaaatcttcattatatcaaatctagaaatatattaaaataataacatgtcctgaacatgccagtttataataggaatgtatagatggtttatagtgagaattaaattctgcacataattcattatattaacagatcaagggaagaaaattattctcctcaataaatgttaatgtaatctgctttctgattttttaaaaactttagaaaaataggaatagaccaataattctttaacatgttagatatcttttaaccaacactcagcataatgtttaccattaaaatattggaacagtatttcccaaactatattttgttgacgataagctgcaaaaggtagaaattcttgttctatctcttgaaggaatgtgtttccataaatacaaaaaaaatactacatattgtattctcatcttagaaattcaaaatatacctcactggattaagtctagaagaatagcaaaaatagcaagtaaattctgaaaaagaagacaagaaaaacatattataaatccacagtgttaaaatactgtggttatagtaactgaaggaatagacataataaaacattgcaaaaaaagtaaatatgagattttaaaatacaataaatagtccatttcaaaacaaggaacagaattcagattattccataaaagataataagacagctagaaaaaaaatatatatatatatatatctcagacctcaagttcatattttactaaaaaggtaaagttttcatggcccaaagagttctatatcaaaaatgaaattataaagatggtttaaaaaacatagatggacttcaggtatgaacatggctatcgaagtctatatatctctctcctcctagaaatcatacaagcaacaaaaagcattaccaaaaaatgcagaagcttcattctcagtgaaacttggaaaaaaggataattgaaagactttaaatcacaggtaatgactgagaaatgcagctgaaatagaatagaaaccacatagaaggaaataaaaagaaaagtgcaaagagtaaagaaaagccataatgctatcaggactcaaaaaatgctgcacaaatccatctccttaagcaagagccacactttagtataataggtatgtcccttgtctacaacagtggttgtgacatataggagatgagcagagccagtggcaaaaaaaaaacctctttgatcaggtttggttgaaagaagcagagaaaggtctacatgaagaaattgttttaagccctattcaatggaagcagtctgtctctgaaaccattcccaaaaagggacctctaagctagtggaggaaaatatgatcattcaacaatgaccaataaaatgaattagcacagcattgatataaggaagatctagtgaataaggggtaaaagagccacaaaatttatcattaggtaagaacacttgccagaaaaatgttgccacagagcagataaaaattttaactaaatattttatcatgaattttaattgattaaatgaggccattatctttgtaaaggaagaacagaaatacaggaacctagaaaagatgtgattattcaacaaaagagataaaacatgagttaatgatatatactccaagaaagaataaatgaataaatcgtggaagaagcaaaaatgagtctagatactctggaaacacactaagaaacctagagaatattaaggacaaccatgaacatcataaaacaaaattcaagaaagcatttctattaaagaaaaaatgtagatctagaacacaggtaaaggaggtgcaatgtatatataattggagcccctgaagaaacccaaacaatgcagtgaagcaaatatttaatgacattattcatgaaccttcaatgaaataaaaaagaatataatctgcatgattgaaagcacgcactgtggaccaggatttttaaaaaaagacctagaacagttaacatgaagactcaatcatggtagactttccagacttttttttttttttttttttttttgagacagagtctcgcttagtcaccccggctggagtgcagtggtgcgatctcagctcactgcaagctccgcctcctgggttcacaccattctcctgcctcagcctcccgagtagctgggactacaggcacccgccaccatgcctggctaattttttgtatttttagaagagacggggtttcaccacattagccgggatggtcttgatctcctgacctcgtgatctgcccacctcggcctcccaaacagctgggaatactggcatgagccactgtgcctggcctccagactttaaagaaaaatattctgaacatagaaatcaatctggctccagatttatccactgttaaacaccaaaagacagtgacacagcatctaaaagattctcctggaaaagtatgatctgtccttccagtgtaaaggctctggttatttttaattgcaagaaactagggaatattggtatcatgagtgcttcttaagaagccactagaggataaactttagccaaccagaagataattaggaaaaccacaagcagaaaatgcagtggtgagcgctggatgggtttaattgtgaattaagagcaaaacaaatgtgcggactagatgatagagtagaagtaaatgttatatgccatgacattgtaaaaatggtatgaaaataaaacttaggagaggaagggaatgagaaggtgaagggcagagtaagtttgccagttacctcacttatgagacaacaggcgtcattcacagctgacaaatcaagtggtagaggtataaacacatctccctttggaagatcaactctaagaccaacaggcattattgactaaaactgggtggagagccaggggagaaaggagcaaatgcattaacttcatcattgttttattaagaggaacaaatacacattgtgtcaaaaataggggatcaagggtatgtttttttctagatggggtctcactgtcacccaggttggagtgcagtggcatgatctcggctcactgcaaccttcgcctcccaggctcaagggatcctcccacctcagcctcttgagaagctaggaccacaggtgcaggccaccaagcccagctaattttttgtgttttttgtagagacaggatttcgccatgttacccaggctggtctcaaacttctgagctcaggtgattcacccctcttggcctcttaaagtggatatttatttatttatttatttatttatttagagatagagtctcgctctgtcgcccaggctggagtgcaatggcacaatcttggctcactgcaacctccgccttctgggtttaagcgattctcctacctcagcctccctagtagctgggactacaggcacgcaccacctcacccagctaatttttgtatttttagtagagacagggtttcaccatgttagccaggctggtctcaaactcctgacctcaggtgatccactctccttggcctcccaaaatgctgagattacaggcgtgagccaccgtgcccggccagcatatttattttaagtgaaattataaaagtaaccattaccataaaaatacaaacctttctaaacttcagaaaaagtttcaaaggaaacagaccacctggtgactgactttatttgaagacatacaaattaaaaaatatcaagtaaaagaatatggaaaaagtaagatcaaaagcatctaccactaatgaaggtcaatgagcttcttcaactcctttcaacttatcttcgatgaatgaaaggatggaagaaagggaggaaagaagggctaatgggagggaggagaggggagactggatgacaaagcaaaacccagctgtaggctgtgcgtggcagccattccaaaaacagaataattcacaaggatttgtaaaagatttcaaaactcaaatactaagaaaaaagagcagaggttgtgatattaacatcactcaagacagactgcagatgacaaggcattgaaaaaaaaacaaaaatgcccctttattagcttaaatggtgcaatttcacaacaaatatataaagctcttaatatctgtggacctccctctgtccttgatatgtaaaatggacaaaaaataaattgcagagtacctaaatagcataattaataaaggaagtctggtttatagatacagaaatacatacatgcatacattcatacacacaccctgaaaatttaaaaaaacgccttcagctcaagtgccaatgaaagtggataaaaattggacatggttaggcctgtcaggcctgtgagcccaagctaaaccatcatatcccctgtgacctgcatgaatacatccagatggcctgaagcaagtgaagaatcacaaaagaagtgaaaatggccggttcctgccttaactgatgacattccaccattgtgatttgtttccgccccacgttaactgagcaattaaccttgtgaagttccttctcctggctcagaagctcccccactgagcaccttgtgacccccgcccctgccaacaagagaacaaccccctttgactgtaatgttccactacccacccaaatcctacaaaacggccccaccccatctcccttcgctgactctcttttcggactcagcccacctgcacccaggtgaaataaacagccttgttgctcacacaaagcctgtttggtggtctcttcacacggatgcgcgtgacaaggccaaaaacaaaatctccagaaagtaaaaacagggaagaaaattttctatggtcacgatgctacaaaagtagaaactgaaaatcaaattgaaataccaaaaggcccttccacctgggagggaaaaacacacacacacgcttttaaacaatcctgactcaaagggactaaacagaactgcagaatgcccagaaaaccagaatgaagtggtcacatgttaagaatctagaggaaaaagctaagcaatgctcagcataaaacacttaaattctattgattaagaagagaagaaaaacaaagaatgaattgaaacaaatgaattaagcatccaactcaaaaaggttaggaagagaagagcagagcaaacaaaagaaaagctaaatggagaattattttaaaagcagaaatgagcaagttagaagtcagaaaaacagtggaaaataaatctgaaggtttttttcttttggttgaataactttttatagtagtgtctgcatttaaatacctgcacaatgtcaagtggtcatgcagtagggaggagaaggagaattctgaatagagggaattgactattttaggcggaagttcccggggcctaaccagcgggggccaggaggacaaagagaggactgaattgctttgtataataaagtgagagggctctgtggggagcctgagactgaggggtaagggttctaaagaggaaagaacgcaggaaatatgagaagtggagaaagagagagagcaacataaagggaggttgaggaagatgaagtgcctgggcgggatccagtctctcctgcactttgcgtccactctgtggtttacatgtccgttacacttggagtgcgtcttcagtaactccctatcacaggaaagtcaatcgtgttcttgcatgtctgaaaatgtctttaagtgtcctgcaaacttgatgatattttaggcaaagaattctagtgtcattctttttttttttttttttttttgagacagagtctcacactgtcaccccaggctggagtgcaatggcgcaatcttggctcactgcaaccaccgcctcctgggctcaagcgattctcctgccccagcctcccgagtagctgggatcacagacgcccaccaccatgcccggctaattttttgtatttttagtagagacagggtttcactatgttggccaggccagtctcaaactcctgacctcatgatccgcccgcttctgcctcccaaagtgttgggattataggcgtgagccaccacgcccggcctctagtgtaattctagtgtgaaatcattttccctcaggattttcaaggtatgactccatttgtcttcatatcccgcactgagtggttaaaaagaaaacagcgatcaacatgcactaaaatggatagctctccaaggcacaacgttgaatgaaaactacaactcttcaagtaaattatgaagagtgataccttttatatcaaaggaatctggagggggactcaccagtgcttcactgcggggaggggaaggggcgctggaattggggggcctggtcaaggtaggcaacagacctatggattgattatctatgtacttttcagtttgtcttatcaatgaaacttccacccaccagatgctcaataagcacacaattctgtgttcttatagcttaccatttttaccacctttatatttaacttttaaatacaactggaatttacttagttacatagtatttagttatataggacggtttacaagaatattttttcctatttccttttttcctattccctatttcttttcctatttcccttaccatttgttcctacaccatttattgaatattccttcccttccctactgatttaaagtgtctccttgaggcatgtatcaatttgaaaaatatgtagtgtagaacccaggtgtcctaattcccagcctggtgatcatttcactccatcactgagtagttttttaaattatttttcttttagacattgtctttttcttaatttttaaaacatttcagatttctaacactctgttttgttcttggatctgactctagttggatttttaccacctgcatttgttctatttttctagggtttgagtaaggggttggaggaacacttaggtttgttaattcattcactcagcaagcgtggctttagcagcagctatgttccatgtactgttcccagcactggggatattaggacatgagggcaaggggttgcctcttatgtttttcttttgtcttttgtttcaagctatttccccaagttttttcagtttaattattcacttcatctgccctatggccacagttccatggactggtagcaagtgaccagtacctgctctttgggatcatccatagctttgaaaactattgtctttctttggccaccccacatccctagcaagctacttttcccaggccttacaaagaccaaacctactccgctcctgtgacaggaatgcgtttcactctgtagaagtgggggttcaagatgctggcatctgactatgaacccttttccacctctacttctgctaaaaaacaaaaggactagatcataagatctgctgcgcactttccagaggaaaaaaaaatgttctttgtagcatagagaaccgaccaggaagcattgtgagaccttttccagtcagttctgatttattatacaaactccaggcctccaagagcaccaggtttcatggaactctctgcggtattttgaatccataagccaatgaatagatattatatctaaaccacaggaagcatctacttatctgtggtaagtgttgcgatgtccttcatttaataaaccacttagagacaccgtgtgactgaagtgaggaggactctgtattggagtttaacttgctcaggtgagctaaactcagtggaaattaaagagagatggtattttgtgtttggatccatgacaaatctaaaaaaactaaaataaaagtagtatatagtcatgatacttctgtgagcagcaggtgatcatctttactactttgactgcatgcatgactgtcataggaataatgtttcatactaaggtgcagatactccacataaaaagagtgattttgaacctgaaacagccctcaagaagacagtttcccaagtgggatgccatagcacagtggagtttgtcaaacaagttaaccccctccgccctcaacaccagagccaagacctctcacctatcaccatggacgccctcctctcagtacaaatgctgccatttcctgacgatgccatgacgcagaagaaaagaagaaaacaaaaccataaagcactgctacagtataacttaagccaaggacattatggtgtcaattttatagaaaaatcgtttagcaaattgtcaaagttgtggacattccaaatatgcaattgattttcctattttccttgtagtaggtatgctgagaagaaaagtctccagaaaggaaatgcttgcttaaaagtgagcacctggtataccgttagtgggaccgtaaaatagcacagctgctgtggaaaaagtttggccattcctcaaaaagtgaaatataaaattaccatatgacccgtcaattccactcctaagtatataccccaaaaagtgaaaactagcactcagatatatatatacatacatatatatatatatatatgcatattcaaagcaatgcaattcacaatagccaaaaggtggaaacagcccaaatgtccaccagcagattaacagataagcaaattgtggtatagtcatacagtggaatactattcagccataaaaaaggaataaagtttggatatatgctacaatgtggctgaacctcaaaaatgttatgctaagtgaaagaaacataatacaaaatgtcacatattgtagaattccatttacatgaatgtccggaatacataaatgcatagagaagaaatgcagcttgctggttgccagggcctgaaggaagcaggcgaagcaactgcttcaggggtacaggcctccctttttgggtgatgagaatgctttggaactaggtagaaatggtgattacacagtgttgcaaatgtactcattgcaagtgaaactgttcactttaaaatggctaaatttttattatgtgattaaacattaaataatttttaaaacagatgagaaaagaactgtaagcaaaaatataaagtaaaacagctagggcaccagaccctgagcataacatcagttaaatgataagaacctacagtctgctctttcacacttttgtgccttctcttttctgcagaagctttgcagagtttgatttctgcaaaataccacaccttacatgcatgccacaatgctgtactcctcattgcttctgagtcactgatagatgaggaaatctgtcctcaaagagagagctggaaaggaaaggcagaggggaaaaataaaccttacatccttatgcctgcatagaggacatcgcattcatgtttaacaaaaacagaaaacaaaacaaaaaaaacagacagcaatatgaagacagaagtatgaagagaagttttgcagcatgaagataattccaggctggtgtgatcatgggagcattgtcatttctggagacttgacatttccaaccggcaatcgtttaaaatcatgtacatgccatttgcaactgaacatgctagtgggtaatttgttattttgagatggaaaacaaaggcacacagaggttctcatgacttgctgaaacaagagaccaagaattagaacccagtgccccaagtgatgagttctgggccctctgcctctagcaggggctgtcttgttggtgatttttctagagctggtggagttcggcctcagcacagaacctgagtgaagaagctgtccaaatgggtttctcctttccctacctgcaggcttacccttcatctgacccatcctgtaaactgatactaagacagcaattcttaaatacctcttccaatgtgtcaggtacctaccaggacttcccacatcctaccccactccgtcacttcttcctctgtcccagctcctcatagccaaagtcacttcccctaccccggtcatctaccctctgtttgctcagtccatggggaatggcctcctacacctcatcctagactttggctctgcacccttcccacatctctgcccttccaaaccctcctcctccccacggcatgaaacacagggctaagaactccagcaaatacttaagtcagctgcttgtctcttaggattgaggaaccattggcatctcagcttctgcgagcccacacctcctttgaaataagcctgagagctcagagcttcaaatccaaaaccaacctgttttcagccacactgctcaccaccttgggggtgcaaaatgagacctcccaggccacctgagaagaacaagaagcttcttctcttgtaagctgcccccacatagcaacccctcttttaagagggtgaattagtttccagggctgctgtaacaaatgaccacaaactgagtggcttaaaacaacagaagtgttctctctcacagttctggggaccggaagtccaaactgaaggtgtccgcagggccgtgttccctctgaaggccatagcgagtctcttgcctgcctccccgtgacctccggtgggtgcctgcagcccaagcattccgtggctcctagctgcagctctccactctccacgtccatcgtcacgcagccttctttcccccatcgctgtgtctctgttctctcttcttaggagaacatcagccaccgggtcagggcccaccctcacccagtacgccctcatcttaactgttaggttggtgcaaaagtaatggcggcttttgccgttgtacttatatctgcatgactctatttccaaataaggtcaccttcagaggctccaaatggacctggattctagggggacactatccaacccaataccagagggaaggtggggagtgggaaagatttggaattagcattgtaaggaggatcattccagtttctgttactccatctcctcagctcccctgaaggactcaagtgccagctcagcctttgccatcttgtcgctccctctctaggccgcccccagtcccagatgggctggctgtctacaggcaccagctgcctttccatcctgaaggaattcctcagccctggcctgcctcacctgagtgtaaagtttgcagagacagatattaaatcaggttttcacctggttcattacattctgatgattttgaactactgggattttcaatctgaaagaaaacattttgatacggcaatgcccacaggacagctctaggatgagctgttaaaggacatttagtgcgtcctgggaagcagcagagtgtgaggctatgtacagacgcgccacttaaaacccaccagtcgactcgctagacggcccaaagggagatgtagttatgtggaagagctttaatcagaatttaggcataaaatgaaaagctccaaaggaaagcaggtctttcagtctctgcacggcatcctacagattcagcccagctccttttaatgcaaagtttaccaagtcaagaaggaacaggcagcccagagacactgggtacaaatcatggctttgccaaccttgttcctggcattgagctttgactgggctggaccatgctgtttcagagaacccagctctttctttttatttatttttcttaataggaagggctacttgcatccttcagtctacgaactgttctggagctcagactcgccattgccaatgtgacacatctatacgctcatctcttcccgagtctgcagtcagccttgtgtcagaagagtcctgggtctgacttcctttttgtctcttaaagcccttggcagagttccccacaaagtgccttgctctcccgggggttcagaaagttgagtgcaatgagcagaagcaatgtgatgtgttcacgggattggatttgtatacataagacaatattcagcacacactgcattcatatatagtaacgagtaatgcctattgggcagcagaaggggatgctggggaaaagggagcatgtcctctgagacccaggcttcatctcctgacattggcaaaccagctgtgctgtgcagccttcagctgtttttcagcctccaggacgtctctaccagaggttccgaggggcgtctctcgtgacgtgtctctagtgacaggttctagacataagagagaaagcatgatagaattttcttactaggccattttgcattttgcagatgtggatgcctggtaagagccagaggaaaaagccccaggtcagattgtcactgtgagccaacctggatggaaagggagctaaactatgaagccacatgagacgggagctcagagggcccagagcagaagtgaggtgagtcggacccctactgtgcctgcacgtcccccgcccccacttcccccactcatatgccaaggtcctaaccctagtatctcgaaagtggccttatttggggataagctcttcacagaggtcatcaagttaaggtgaggccattagggtggccctcatccaagatatcctgtgtctttataaaagggggagatttggacacagagacaggcacaaatagagaaccacgtgaagattcagggggaaaatggtcatcaacacgctaagggcaaaggcctggaacagagcctcccctcacagcctcagacggaagcaaccctgtcagcatctcgatctcagactttcagtttccagaactgtgagacgatacacttttgtttaatccacactgacagttaagccgtaaccttgttacagcaactgccgcaaacgaatatgcctgcagtgaccggtcctgtatgcctgccctgctttgcaggtacatgggggcattgaaaatggaatccatgcccaaaccagcctcaaccagtcccctttggtcaggtcgtggtgctgtcagctttcatcagtgacactcatttccatgacattctagcttaacagatatggtgcaccagaaagctgcctagcaatttcacaatatcaaccaaattattttaacatggccatcttttcattcagcaattgcgtgtccaaggatgtagagaatttcccccaagaaatacagacaagtcctcagagatgcatataaggatgtttgcaacagcatttttctgttcctcattgattgttttcatattttgtttgaaaataattcaaatttacaaaaagttgcagaataaaaatagtaaatgcttgtatgccattgacccagagtttctcattgtccacagtttgcttcatttatcaccttcatttatcaccctctctctctcaccctctctcaaccatttgaacaaagattgcttacctttcagccctttaattctaactatttcaatgtgtgtttcctaagaataaggatatcaccttacatcaccacaatacagtcaccaactacagtaaatttctcagtaaatcaggacatcccctcatcaaaacagtgtttttattcaatctgccttccacaatccaattttatcaactgacccaaaaacgtccttttttttctccaccacaaaatccagtccaggctcaggcattgcatttagatgtcatgattctttcatttcctttagtctacaacatttccacagcctttccttgtcttttatgacattgacgctattgaagaacacaatttatttttaatagactagccctcatttgaggtttgttgcatgtctgctcgtggctgggttcaggttactccagttcaaggtggaaaaccccacaaatgatgctctgtccttcccagggtgtcccatctggaggtccaggatagccacctactcctcactggtgatgtcaatttttatcactcagtcaagtattgtccaattgctcaattgtgtaattgctactttttcccttgtaaataacacgcagtctgtagggagacactgtaagaccctgtaaatatcttgcttcccttaggtttagcacacatggatgacttttgcctgagccaatcttgactctaatgcctatgaaacgatagttttccagctccagcatgccctctagagtgactgccttactcagcatcctactacaaacctcactactcacacgtgtgccagaggacagagacacaccctgcagggcttcctgagcctggcctggtaaggaagtttccagagctttcgcagtcacgacatctcctctatgacaagagacaagttcctgcccttgcattacttgccacgaagaaaacgacacaatctttgcaggctgctttgaattttagaggcaagacgaaccacatttgaaaatgctgctttaactgtataacccaaaaggtaaccctgtcaacccagaacgtcttttccctgcccccagcacttctatcagactcaccattagtggagttacagaatgcctccatgcctgaaccagtaccctggtatcccgcgtaatatcatctccaaccagggaacattttacaataaaggaaatgattccatgggctcaggcctacagaattccctgggtttgctacatgcctaataccagaagccactggctggacagaatgatgaatggtctgctgaaagcctggttatagtaccagctggaagaaaacattcattccgtctatgaagtaacgggcaaaatgcccgccttaaagtttagggattaaaccaatggtcaacctatggtgtcatcatccctcatagccaggagcacaggccatggaaacaaggggtggaggtggaagcaccccctcactattacgtgtagtaacgcactggagaagtttgcttcccatgcctagaacgttggctttggtgggtgtggaggttgccttagtccattcacactgctaaaacaaaatagcataaactgatagcttacaaatgacagaaattcatttcccaatagttctggcagctgggaagtccaagatcacagcagattccgtgtctggtgagggcccatgttctggttcatagacggcgccctctcgctgtgtctgcacatggtagaaggagtggggagccccctagggcctcttatataaggacaccaatcacatcacaagagctctgcccttatgacttcccaaatgccccacctcctaataccatggccttgggggttaggatttcaacatacaaatggggaagagagaacatagacattcagacaatagcagaggcccatgtccaaagcaggaaaacaggcatggttctgagtaactggaagtcaagatctccttgtgaggctgttttggcttccttgtgccaataaaccaaggaccagagtggggagtccagcggaaatttgggggaaggtaccaagaaggactgtttgaaacctagagaatccatggggttcctgctttgttctcccttgcctcatgttcctggtcaacagaaaactgcagaaaggtcaccacaatctcatgtcctgcaggaatgcagccgtgggtcacctcaccaggtaaagaatccatccagcatatggctggcaaaaggcaagggaactagggaaaggaatggctggtggaaaggagcgctgggcctctcaggacctcctgaccagctgtcaagcaggatcgtagcagctaggtgtatgtacccacttgattgtcactgcctcagtcctaaatccttatgtgaagggcataggcttggctgacctttcaggtttcaagtggaaacacaagtaaattaacatcactttgcaataagagtagttgatggcacttcatgcattccctgtgctggggacatgagctttttatccaaaagaacagaatagatgctgggggcaaaggggtgggctgggccagatgccttctgtttgctcttccaggtttgtctcctcctgctgcaccttggcctcggccccaggaggctggattgctcacactctatgacaggcccccagaaagtctgtcctctagttgggtttgctcagcgggagccccagcagcagaggaaagggagtgaagtcagggtatttcttctctggttcctccctgaggtcacctcgggctggtatgtcactgttcctccctaggtggcttgctccaaccactgtttcttccgggtttcagtgacctctcctatccttcagcccaggcaggaatggcttcactgtcacaaccctagttcctgcactgggctatggtttccttatacctgccacatctttgattattttctttataaataaagcctccttgatttatcctaagagagcacaccatctgttatcccttggcgccctaaccaatacacagagtttcaatagtgtgcccagggtcctgcaactgtgaagcagtagggacagcagtgacttgagaccaggctcccggccctgatgctcgttcctgccccagccccttggcccacccaggaggatcctgcaccttaaaggacaatccacctgtgctcacagctgccagctcccagcacccacatcctgtacatggggcaggcagaagggctacacacagaaggccccacacaacccctccacccacaggtatggaacagttgataaatgcccagtgtccaccccctcaggggggacaatacacattccctcagagagctgcagcaggatccatctccagccacccatgagggtgaccagcaggccctccactgttcacccccatttcccaactcttttcctcccctcttggtgtctcctgggagcacctccccacacactactcacacccaaacctttgtttcagcaattaaagacacccaaactgacatagcacccggcctgcactccctccttctgtgcaagccacctccctgagctactgagcactcaaaggcaagggtgtagccttcagagatggagaagaaatcattttcacattagaatggcacagccagccaaacggtcaatgaagggaaatagcaaaatggtacatcttctgagacacacagaatgtggttgacagggctgagcatggtggctcacgcctgtaatcccagagctttgggataccgagtctggcggatcacttgaggtcaagagttcaagaccagcctggccaatacggtgaaaccctgtctccaatttaaaaaattaaaaaaaaaaaaatccaaaacttagcccagcatggcggcacatgcctgtaatcccagatgcttgggaagctgaggcaggagaattgcctgaaccttagaggtggaagttgcagtgagctgggattgtgccactgcactcctgcctgggcaacagagagagactccatctcaaaaaaaaagggggatgtggtttacaggatagcagctcccaaagacatctatgctcgggacctgtgaatatgcaccttacgtggccaaaggggctttgctgctttggttagggttacaggagcccttaaaagcacaggacttccatgggctggaggacagaggctggacgcgtagagaggaactcgaccgctgttgctggccttgaagaccaaagaagggggtcaggagcagggaacatgggtggcttctgaatgctaagaacagctccccccaccccagccaacagccagcagggacacggggacatcagtcccacccctgcatggaaagaaattcggaactttaaggtaagaaatggatattgttgttctcactcttaggtgagagctaaacaaaggtacacatggacatacagagtggaataatagacaccagagactccaaaaggtgggagggggctaaaggatggaaaatgatctgttgggtacaatgtacactactcaggtgatggctacactaaaagcccagacttcaccactacacaatatatccgtgtaacaaaactgcacttctaccccctaaatctatttttttagaaatgaaaacagtttgtgatgcatctttaaaacaaataaatagatgttgttttaagctcctaagtttgtggtaaactgttatggtaaaaagaaaacgaatacacagaatgacaaaaatttatttccacatgccacatcttagaaaactgcctgaggatgcactctagcaaaaagagggagtaaacaaagaaagggggtggtgcaggggctagaaaatagtgtcctccactgaggacagtggagaccaaacacagatcccacaggggcgggagctctccagggcaaattggggaagcggggctgagcccaccaagggtacaggtagggatcagccctcagtctccagcagggccaagccagtctgtagaggggaacacatagaagagcagctgccttagtcagtgaccccaaaatactaaggtgggaagaaagccccagttgcctgctggtgatagcgggcagccagtggtgcctccatcatcactctcagtggaaggatggcgacttggcccaggccttagtggaagacttgtacctcaactgttttcatcttttctttgggtccagataatgaaacatctgtggcaagagagagaagagaaagagaaagagaaagagagagaagatgtgtatctcttgtgttgatgaaacacaagaattagatgtttaaatatattatttagagttacacagctaaagaaaagtggaactaaataagtgatgtcgttataggaggaggagaagcaggggtggggtgaatcctcatctatttcagcaggaagctagtagatggtgtttaaagttgataaatcaagagagagccacataagtgcattgtttacagacatggaggtaaccaccagatttaaaatgagacagttaaaagcagttttgtttcgagaactgaactgaggaggaagaatagagcaaaagcctgttatttttcactacatgcccctctgtactatttggttttctaatcccatgcatgaaatccttttatatatattgtttttacaaaagaagaaaaagagagagaagaagggagggagggagggacccctgcctgaacatgcatcaccaaagccagagccagcaggaggttgcaacaagctggaactgctcaggctgtgcccaaggagcccccagcactgctgccctcctgctggtgtggggcacattgctccagagatcagggtggggtcagctggcagcatgggagacaggctcaaggatggggaacagcctgggtcaggagagtatgatggtgttgaagctagccccagggggtctatcaaggcaggtgtagcaactgttccagacacttccagggtttggcctaagcctggacatctgtgtttgctaaggagattccatcatttgggggacaacttgaacagatcactcaaggaatgaaaactgggcatatgaccagctgactcttcctcctcttcttcccaatgtcctcagagaagtaaaataaagcccaaactctccagcagagtgcaaggtacttgttggaggaaaggaagagaaggctgctctttaggcgacttgtccatagcaaggccagctggggccacctgtgggagacctttgtccaacccagaatgaggtgtcagctggagcttagggtcatattgactccatataagggtcatacacagaatttgagggttcacaaaacacattgcatgcattacctgatctcgtgctcataagcaccctgcaagtatagaaggccaatataacttcctactgacaagtagggaaagctcaagctcacagagagtaagtaacgaagccaaagtcaactgtcctgagtagccgtggaccgagctccctgtgtccctgctggctgttggtcggggggattgttctttgcatttagaagcctcacacattccctgctcctgacccccttcaaggccagcagcagtgatcgagtccttctctatgcttccagtctctctgagctcccttctgcttgtgaaattctgctgcttttaagggctcctgtaaccaaactaggctcacatggaaaatccaggattctctcccacctcaggttttataactgcaacagcaaagtctctttggccacgtaaagtgcgtatttacagcttccaagaatcagagcgtggatgtctttgggggctgctatcttgtcaatcacattctgcgtgtctcagaatatctatcattttgccttttcccttagggaaaaaagaaggaactggaagatttgctgggcctgcctgggccacctggggccagctgttttctaaacaccagctccatgacaggcttcatccacagacatgaacaaacaggctctagggacagcggccccgcatctaacaagatgcccatgctggctgtgacctcctagacatgctcagcagcaaatgatttggagatgagagctggtttctgccatggataaaatgtaagtgctggtgggctagggaccatggtcagcctgcccctgggctcactctttcctttatatgcagagagaattgtttaagcccccataacccaaaagtgggcaccccccgcatctctcagggttctcggggcccccacaggtcttccagtccctgttttttctctttcctccttcatgagtctcatcatctttcatgcagatacccctggacttgcacctcttgctttccctgccacaaacacccacaatgtgcagagccttccccttcctttctccaaaagacagctcctcccaagtaataaaattgtactaaacactcagagtcatagtgagcagttacctcacagaagataaattaaacattagacatttccagttttataaggaagagtcattctcatttgaggaaataaattacaagccaaatttttttccaaatccctcaggccctgcattgcatttctcaacagtgctcaagacctgttctggtcactgtttctttctttctttctttctttttttgatatagagttttgctcttgttgcccaggctggagcgcaatggcacgatcttagctcactgcaacctccgcctcccgggttcaagcgattctcctgcctcagcatcctgagtagctaggattacaggcatgtgccaccaagcccagctaatttagtatttttagtagagacagggtttctccatgttggtcaggctggtctcgaactccctaccttaggtgatccgcccgcctcggccttccaaagggctgggattaccggcatgaaccaccacacctggccactggtcactgtttctatgtcacaaaccaacctaaactaagtggtaaaaaaaacattttattatgctcacagatgtgagggatcaggagttctgacagggtagagtggggccaacttccttcttgaagtcctcttctgggaggacttcaaggctcagtgtgatttaatagctggaggtaaagttatcgtgagacgtcttcactcatatgtctggtggtcttggctgattattgccggagattgttggtcatagcaccttcccatgtagtctctctacctgggcttcctcacaacatggctgctgggttctaagggcaagtgtccagagagaacttgacagaagtgcccggcatttttatgacttagccttgggagtcatacaaaggcactcccgctatgctccactgattgaggcaatcacgaaggtccatccagggtccaggggaagaggacacagactccacctcttgacagaagagccagtgggatgggagatatgactggggctcatctttggaaaatacaatatgccttacgaccacttcacatttccaacctcctctcctccatccttaccaggtgctcagaaaccccaaaagcttccctacttgatgttgcaaggcaatccattgctccctttgtctctcctggccatgccaggtgatatggtttggatctatgtccccacaaaatctcacgtggaattgtaatccccaatgttggaggtggggcctagttggaggtgattgtgtcatgggggtggtttctaatggcttagcaccattccccgagtgctgttctcctgatagagttccaacaagatctgtttgtttaaaagcatatagtccctcccatctctcttcctcctgctcctgccatgtgagacatctcactccccctttgccttcgctataattgtaagtttcctgaggcctccctcggagcctcacagatgccagaatcatgtttcctgtacagcctacaggactgtgaaacagttaaacctctttttattataaattacccaactcaggtatttctttgtagcaatgcaagaatgaactaatatacctgggaagctatccctttcataccagagcattttcccaaatagtcagcactatttaacagcatgcaggtgctcaaatctaggtattattgagaaatacctagccaaaagagtatcttccccaagatcgattatgtgttactcaggtatagagaatttgtttcaccatgatttattgaagccatgtctgcaaagctatattaatactttacccgtattgcaggagaagacagaggggggcaaaaatatttagagtgaagggataaataaatgaatgaatcaaatatggatcatcagccaagacgtggaaataacctcattacttgaaattgaatgttttaatgttattcattaaagtagattttgtctgtatttgtgacatatgtgtgcttaaaattcatggagaaaatgagcattttaattacaaaatgctgaaatcattaataatttaaagatcatcattcagcctccctttctaagtaatctagtctatgctaaaccctcacagacacatcagacaagtcaaggacacagtcaaagggcaggtccaaggggaagggcgaaggggtggggccaatttctcctttactcatgcacacagaagaatttaagcccaacctaccagaatgtatgtggcttaggatgttgcaggggaagtaaaagaaccagagatcacatagatggtgtgaccatctgggtgatctcaccctctctgttaaaggctacagccaccatccgccccttctctcacccaggagcccacaccaggcaaggcagcctcccctggttgcaaagcagcctgcttcctttttcgccttgcttccttcatccgcttgtgtgcacccccaggaaggcgtctctcctcaagtcccatccactaaagcaaacccacccattaagacctcgtcaaatgccacatcctccaagaagcaagaggggcccccagcacccagcccagtcttcatttcacctcctctgtgcactcccgttctcagcactgtctctgtgactgtgcttaccatgtgctcttgtctctaaagaataatgaaggcccaatattcaggatgcatttaccatgtggtctcatggccagctcacacctcctccactcagccaccctcaaggcagggagagtatcctcactttacagagcgagccgaggccaaagggtaagtgacttgcccaccgtcccacaagcaatgttggaaatacagatgaacgctgatgcacccactccgtccagggggccaccaatcacatgttcacctgagtacaggatactctggaaggctgagcaaggccacactaaggaggatatggttcccccactaccatcctcccctgcgttggggttcactttcagggtctgatggtgaattgtgagttacatctgccccatctgggagatgtacaggttatacgcctgatatggtttggctgtgtcaccacccaaatctcatcttgaattatagcttccataattcccatgtgttatgggagggaactggtgggagataattgaatcatggggattgtttccttcatactgtcctcatggtagtgaataagtctcatgagatctgatggttttttgtttgtttctttttgagatggagtctcgctcttgttgcccaagctggagtgcaatagcatgatctcggctcgctgcaacctctgcctcctgggttcaagcgaggcctcctgggttcagctactcagcctcccaagtagctggattacaggtgcacaccaccacacctggctaattttttgtatttttagtagaaacggggtttcaccatgttagccaggctggtctcgaactcctgacctcaggagttctgcctgcctcagcctcccaaagtgctgggattagaggcgtgagccaccgagcctggccaagatctgatggttttataaggggtttccccttggcttggttcttattctctcttgcctgctgccatttaagacgtgcctttgccttctgtcatgattgtgaggcctccccagccatgtgaaactgtgagttcattaaacctctttttctttataaattactccttctcaggtatgtctttatcagcagggtaagaacagactaatgcaatgcctttaaataacacagtgtgtaatgaaatagggaaccacagataccttctgttactgcacaaagatttgccagtaagggcaaggtacttgtaacagttgtcaaacataaagagtttagttacactttatttgcacccaaaacacaagttttctaaattggcttgattttttattttgaagacaagaagtaagtattcagctatcatacaaatatttttgaaaaataaacacattccatctgtcccttcaaagtgaaagtaacattttaattagtgcatgaaagagagtaatgctatgcagagtttctgaaaacagatacctgggaatgttttcattattacatgactttgctgcccaaaacaagataatatgtaactctcatatccgcacacttaaaactgaattttctaatccatttaaaagacttccaaatgcatttttgagtggattttgattccctatgtttaaaattgcataactggtggatgggatttttaaaatgaatttcatggtttagtaagcacactcatgtggatctacatatatctctgaggtgtcactcccagctaagacagctttaaaccatgttaaaatgagctcatcttagaaccaagcttcagatcactatatcactatatataaaacaagattttttaataaagcatatttgatcatattgctattattaacatttttaatgtattttagtaagaaaaaaatggtaccaaaaatttcaataccataatggtattaaaattccataaatggaatttatgtaatgtaattccataaatggaaatacaggcctggcatggtgcctcacgcctgcaatcctagcactttgggaggcggaggcaggcagatcacctgaggtcaggagttcgagactagcctggccaacatggtgaaaccctgtctctactgaaaaaaatacaaaaattagccagatgtggtggtgggcacctgtaatcgcagctactcgggaggctgagacaggagaatggcttgaacccaggagacagaggttgcagtaagctgagatcgcgcaactgtactccagcctgggagacagagcaagactctgtctcaaaaataaataaataaataataaatggaaatacattactttgtaaatattgtatatcttatctttagttcatttgtagtttctatttttatatactttatgtatgtgtatttttgatgccttttagccaaagaccaccaggaaaactcacagcgaggggtctcagccacaactacataggagttgtggagtgaattctagtcagaatgatcacagtgagaagaagcacaatcctggccttgtggctaccattttaacaccaaaaaagcaccattctaatgccggaaaacccaccacttctgcaatctctgcctaactcctgcaaactagatagtgaagccccctctcccaggaagccctcctggactgattgtctactctgggcagagtctcctcatcatcccctctgctctgcttctcccactgtgttttaatgatctgtaaactcaaatggcttcttgctaaggccaaaggccttagacgctaagggctgtgttttatccaccaccacattgccaacccctatctcactgaatagtccatagtgttctgtgaagattgtatgttctgtgaaggcctggagaagtatatccctggaatatccctggagtggcacagccctggagcccactcctcccctgcactcaaggaagggcagtgcagctccccccactccgctgtgcagaaacgcaggcctggttgaattggattctgcaatctaatgagctccactggcaaccagcacgcaggcctggcaccaactctcggcacctgattttctgtcacataaagtatattttaagtatacagcctttgtttgtgtccagcttcttagtgataggcccactgggaactgctgcttcctggctttctgcagcatgagggaggccaaggccctgccagaattttccctccgggggcttgcttgcctctctccaccaactttcctgtcttcctgtcctgcgacaagggtcaccttccccacccctaaatccacacccaatggctacatttggtttgagtgtttttaaataaaactttcaaatctctataggacgaactgacaattttctttggaaccaaatccattatatatcataagcccggccctcgtacttcataaacaatgggcatttttcacctttaccaaataatgatcaaaccttccctcacttttgtatgtcatgatcagtgataggatctttcagcatcagagatgaggctgacagttggtattactttatttcagccttacttggagctcatcccttgggcagattgcaataaacctcctggcactgcaatacagcacagcaccattgttcagtcgacaacaattccatggagagcatccaaagtaccaagcctggtgccagcagctgggctggagaagagagtggggcacacagttccccaaggccagcaacccggcagtgagcaagctgcagctgtgactgcacagcctggtgatgctggctgcaaagacttgacacagatgcgtggaaaatcaaagaagtcacttgtgatacgaacctcgtgatgctggctgcaaagactcgacacagatgcgtggaaaatcaaagaagtcacctgtgatacgaacaaaccgcactgtgttgagctgaactgtgttcccccaaaaaagatatattcaagtcctaatacccagtacctctgaatgtgaccttatttggaaatagggtctttgcaaatgatcgagttaagatgaggtcatgagtgtgggttttaatcccatgtgactgtgtctttatcaaaaggggaaatttgggccaggcaccgtggctcacacctgtcatcccagaactttgggaggccgaggcgggcagatcaccggaggtcaggagttcaagaccagcctggccaacatggtgaaaccccatctctacagaaatacaaaaattagccaggcctggtggcaggtgcctgtaatcccagctactcgggaggctgaggcaggagaattgcttgaaccaggaaggtggaggttgctgtgagccaagatcacaccattgcactctagtctgggcaacagagcgagactccgtctcaaaaagaaaattggggaagggggaaatgtggacatagggggaagacgagtgaagaaggccctgtgatgaccgaggcagagactggaatggtgcagctgcaggccaaggaacacagaggattgctggcccccaccagcagctgggagagagacgaggagggattctccccaaaagcctcagaggagcgaggcccggccagcacctggacttcagacttctaaactccagaactgcagacaacacacttctgttgttttaagccacccagtttgtggtactttgttgacagccgtagcgaactaatacatctaccacaaagtagagggtggcagccatccagttatccagtgagtaattgctaggcaccctctagacattgaggagacttttctaatcatgaaggggtgcacaggagaaggataacggacaaagaaatgcctaagacaatgtcaaggacgaatgccactcagagaattgccacagcgagggcccagtggctcctgtggactggacggtcaggaacagtgcctctgaggagggacacttaggctgagagatgaaagaagagaaggggccgttcctggcagagggaatggataaaacaaaaaccttaaggttgcagctgggcgtggaggctcacacctgtcatcccagcactttggaaggctgaggcaggaggccctcttgaggcgctggacgtggaggttcacacctgtcatcccagcactttggaaggctgaggcaggaggccctcttgaggcgctggacgtggaggttcacacctgtcatcccagcactttggaaggctgaggcaagagaatctcttgaggccaaaaattcgagaacagcctgggcacatagcaagaccctgtctcaaccaaaatttaaaatcaaaacccaaaaaagccttgcagtgggaaacaggtggcatacttgaggaacgggaagcaaggttctccatctggaacagaggggaggagatgcaatcagagatgggtaggactcaaacgatgtgctccagggcgttcagatcctacaatccccacaggcagggcatttccagacaccacctgtgtgagtttcctggggctgccgtgagaaatgactccagactgggtgccttaaaacaatggaaatctattatctcacagatgaggaggccagacgtctaaaacccaggtgtctgcagcgggagctctgagagagggcctgttgcatgcctgtcttctgctccgtggccgcagccgtccctggcactccttggcttacagacgctcattcccactccaactccacgtggccttctcctccccatgtctctcttggtctgtgtccaaatttccctcctgtaaggacctccatcattggattaaggcccatcctaatccagcatggcctcatctcaacatggctgcatctgcacagggccccctgtgtttccacattcagagagcaggggttaggattccaacacacctttcccaggatacggttcaacgcacaacactacccaaggcctgctttctcctcagggccccactggtactagcagtggatggggaaggctgagtgccctcccatatggccaagggaggcccagatgcagcccacacacggcactgccatggcccagacagcccatggaggggggagccccacctactacagctggccactgatggccaggcctccatggtgccagggaagaagatgacaaggactgacaattcttcccccaccagcgcagacacagacagccagggttgctcagcactgcacgccatgcagccccagacaaagggaagaagaccgcaaaccaactgaattcacacatcaggcacctagcagagcagggcccaggcagacaacagagctgcaggccaatcgcgatggcccctggcctgcacccctgtgtatggtggggttctgccctcctagggaatctgccgcagccacagccctgctgggagtcaggtgtatccggcacaagggtgggccctgtgtgagactcatctcctgggaccagagtgacacaggcttagtggcactacctggtgtgccctcccccaccccaactggtcctgttcccagatcccccaggcatgatgaaggggattcagtggggaggggaaggacagggctctgttattcagacccacaagacactggggcaggcacaccacagcacaaagggagtgcagggagaggggctttctcccagctcccggcctcagggagcacaaaaccctgggcaccccgagggctccagcatttccgtggagcagtagaggttcccgaggcaccatgcccgggaatggcagtgcctgagaggtggtggcgctggggaagcgaggctcacttggggaccctccacgcagtgcaggaggccgccagctccaggagctgctgcagaagaaggagatagactatggggaagagggtgggactgcttcatgagaaccaaggaaaagcccccagactcccagcaacagaaggaccttcaaagtcccccggcatagcaggagataggtgtcatcagtgtgcaggcagctccgttaggacttcacggcacagcctggggagcccagaataagctcccattcccactgcttagctgcacaattgagctcatccgtttcaggtccagcatggagccagtttccaaaatgccacctacatattctatggttcaatcaacatcatggcaaactaaacagtaggcagccacctggctgtcattctgccctgaagggtaagatgacgaggtctgttgttatgaactgaagtttgtgtccccccagaattcacatgctgaagctctaacacccagtgtggctgtatttggagagggggcctctaaggaagtaattaaatgaggtcatcagggtggggttctgatctgataggattagttcttatgagaagagacaccacagagcccactcactctctctgcctgcacccaggatatgtgaggaggcacacgggttgtccacaagccaggaagagagccctcgccaggattcgaagcggctagaaccttgatctcggacttcagcctccagaactgcgagaaaataaatgtctatgtcttaaaccacccagtctgtggtattttgttacagcaacctgagaggactaatacatctgtccatccaatacctccccaaggccagtccctggaggggctccagagtggcagctttagcactgttgagaagaagaaatgatatcctcggccaaccgcacccagaatctcaggcagttatggggagggaggctcaaatgcagattccccttgaggccaagagatcctgattctggggtctggacgggagctgggtctgtccgttgttagccaggcctcactgtctgccaccgtgactctgatgcagaggactcctcagcacacttcagccaatggctggagtgagaaaagggagccccagcggcggttggtgaggtgtgagtgttaggttcctaacaggatgagggatagaaagagctgaacttccagagaaagaatcagaccatgagaagacaaacctcaagagcactctcacttcctgtgtttctccttcatgaaattaatcttacacaaagaaatgataaatatttgaggtgatagatactatgatttgatctttacacattgtattcatgtctcaaaatatcacatctaccccataaatatgtgcaaatattatgcatcaatttttgaaatgaaaaaaataatttttaatgacaaagtaatatatgatataatatatgacattagtttggttgaagcattgacattctgataacattaatatcttttcctttttccaaaggaaatggctattagaaattggggccaggcaaccaacccaaatgtccatcaatgatagactggattaagaaaatgtggcacatatacaccatggaatactatgcagtcataaaaaaggatgagttcatgtcctttgtagggacatggatgaagctggaaaccatcattctgagcaagctatcacaaggacagaaaaccaaacaccgcatgttctcactcataggtgggaactgaacaatgaggacacttgcacacaggatggggaacatcatacaccagggcctgttgtggggtggggggagggggtagggataacattaggagatatacctaatgtaagtgacgagttaatgcgtgcggcacaccaacatggcacatgtatacatatgtaacaaacctgcacattgtgcccatgtaccctagaacttaaaaaaaagaaaaaaaatagaaattggggccaggcatggtggctcatgcctataatcccagcactttgggaggcagaggcaggtggattgctagaacccaggagtttgagaccagcctgggcaatatgacaaaaagccgtctctacaaaaaatacaaacattagccaggtgtgatagtgcacacctgcagactgaggtgggaggatcacctgagcctgggaggtcgagactgcagtgggctgtgattaagccactgcactccagcctgggtgacagagcaagaccctgtctcaaaaaaaaaaaagaaaaagaaagaaatcggtgcataacctttcagacctgttacatacctttacatacatacaaattcccatatgaaatatacaaaattattcagtgtgtgtttttgatacaaattatatcctactttacgtattatcctctaatttgcttttttcatgcaacagtacttcctgaaactctatcaatgtcagcatattaaattccatttatacctttaactgctgtataatagttcaatgtataaataaaatgcattatatatttgactattggtgggcagttatcagttccagttcttctctattacaaagattcaatgaccattgttctacatgtttcattgttcacattataagtgctttctttttctcttttcttttctttttttttttttttcttttgagacggagtctcgctctgtcacccaggctggagtgcagtggtgtgatctcggctcactgcaacctctggctcccgggttcatgtgattctcctgtctcagcctcccaagtagctgggactacgggcgcccgccaccatgcccagctaatttttttatatttttagtagagacagcgtttcactatattggccaggctggtctcgaactcctgacctcgtgatccacccgcctcagcctcccaaagtgctgggatgacaggcatgagccatcaggcctagcccccagactgcacatttaagcggctgaacgggggatacttcccaacactttgtcctctcactctagctgacattagaaagcttttcatcatttgatgatctgatgagtaaaagagacttcactgtagttttaatttgcttttaccagattaaaaatgagattgagcattttcccatatgtttaatagccatttgtattcacgctcctataaatttcttttcatatcttttgaccattcttctattggatagttttctttttcttactaatttatggaagttcattgaatattcagcatattatggctttatctgttgcatatatttttcctcgggctgtcaattgccttttaactctgtttacagtacattctttatgataccatagttttaatttttatctaaccaagttattcatgctttcctttacaatttgtgctttaaggcctctacttggggaaaatggatcatggctcctgcaggtgtgtctgtatcctagtctggatcctataaatattaccttatctagaaaaagggtctttgcagatgggattaagtgagtgatcttgagataaggagatgaccctggattatccaggtggccctaaataccatcaccagtgtccttataagggaggcagagggaagtcagactcacacagaggaaaaggtcatgtgaagacagaggcagagactggagtgctgtgacctcaagccgagagactcctgaagccctgggcattccagaagctgaaagaggccagcaacaacgcttcctagagcctccagagcgggcatggccttgaggacatcaagattacagacttcctgccttcagactgagataataaatggatgttgctggttttaagccaccaagaagctccagtttattgtacaatttgttgcagtggtgatataggacactaaagtactactcaaggtttgggggggtggggaaagcctatattttcttcaagtggttttaaagttttacttctgcattcaagtctttaatccctatgaaatttatttctttgggaaattaaattcaagcctttttttttcctgcagataaccaatggttcccatagtacttattgaatatctgtgttagtctaggtcctctgagaagcaggagccaggatgagatgaaatgagcaggggtggctgggcgcggtagctcacacctgtaatcccagcaatttgggaggccgaggcgggcggatcacctaaggtcgggagtttgagaccagctgaccctcatggcgaaaccccgtctctactaaaaaatacaaaaaaactagccaggcttggtggcacacacctgtaatcccagctacttgggaggctgagacaggagaatcacttgaacccaggaggcagaggttgggatgaggaagatcacgccattgcactccagcccgggtaacaagagcgaaactccatcttaaaaaaaaggaaaaaaaataaaagggaaaaaagaaatgagcagggggactactgggtattactggatatctacccagaggaaaagaagtcattattcgaaaaagatgcttgcccacggatgtttatagcagcacaatttacaattgcaaaatcgtagaaccaacccaaatgcccaccaatcaacaaatggataaagaaactgtgatatatatagatatcatatatatcatatatgatggaatactacacagccataaaaaggaatgaattaacagcatttgtggtgacctggatgagattggagactattattctaagtgaagtaactcacgaatggaaaaccaaacattgtatgttctcactgatatgtgggagctaagctgtgaggacacaaaagcataagaatgatacagtggactttggggacttggggggaagagtgggatggggccaagggataaaaggcaacaatagggtgcagtgtatactgcttaggagatgggtgcaccaaaatctcacaaatcaccactaaagaacttaactcatgtaaccaaataccacctgttctccaataacttatggaaaaataagatttaaaaataagaattaaaaaaaaatgagcaggggtttattaggggaatcacctttgagagatcgggggtaagaacggaggaggctggtggaggacagctggaaagaggatgggaaggaggcattctagatgcccacagtctaagggggagcccctagtcaaaggcacccatcagaagaggcctgcgtctcccaggaagagccggtcctagctcccctgctcgcaggcaggagctggtgcaatggacttcccagagcggggccttgctcattaccctgtgtagctgaagctctgcaaggtgcattcccgtggccaccagcccactttttcccactgacttgagagccacctctgtcaccaaatctgctcatgcacagtcaatcacttcctcaccctcgccagtgtcccactgctttcgccactgcatcttaagagtccgtccaggtcctcgggaagaaaagcatcctgcccttctccttctcctgggacccagtagctttggcttttattctgtgtttactcgttcgtatgaaatctagaatggatttatcaacttcctggaaaaatcttgtagagattttgattggcaactcattgaatttataagctcgtttgagaaaatgtgacctccttaccacatggaaccttcccattttttaacataattcatctctccttttatttaggcttttttttatgtcctactatgacattttgcagatttctccatctaggtttcacatttttttaaaaagacttttttttttaagagcagttttaggttcaaatcaaaattgggaggaaggtacgcagacttcccttatcccctctgtccccacacacacgcacagcccctcagacacagctggcatccacaccagagcatatgtttcttacactccatccacccacactgatatgtcagtatcacccaaaatccatggtttaaattagggttcctccttggtgctcttcattctatgtgtttgaacacacgtataatgacatgtatccaccattacaataacacacagagaattttcactgccctaaaaattttctgtcttccacctatccatccatccccccaaccctaggcaaccactggtctttctactgtccccatagttttgccttttccagaatgtcatatatttgggagcagatgtatgtagcattttcaggttagtttatttcactcagcagcatgcatttaagttcttccatgtctttttatgacttgatagctcattttttaacactgaatagtattccactgtctggatgtaccacagtttgtttatccattcacctactgcaggacctcttggttgcttccaggttagggtaattatgaataaagctgctataaacatccatatgcaggttttgtgtggacagaagttttcaactcatttgagtaaataccaaggaaagtgactgctggatcctatggtaagagtatgttttcttttataggaaactgccaaactgtcctccaaagtggccacaccattctgcatttccaccagcaatgaatgagagctcctgctgctctacgttctcaccaggattcagtgttgtcggcatcctggatctgggccattctaatagctatgtagtgacatctcatggtcatttggttttaacacttttttgttagattttgcatctgggctgtgttcacttgtgagttagaggaaatctaaacaccaatggctgtaaccagtaaggtcccctacctctttgtctctccctcccaacctcacccttcaccaagaagcccaaggtaaggcagcccaggccagtgatttgctccaggagatcatcaaggaactgagcatcttctgtcttttcctccaccatcttcagcagaaagtggtcacaatgtgatcccaagaagcctgctgtacctcctggtatcttgtctgtattccaggcaggaagaaggtggaagagccaacagcagcttcttaccaagtgctgtcttcttatctgatgaggagccccctcctgcaggaattctacttacatatcattgagcagaccatcacacggctaacaccacctgcaaagatgctgagagatcctttatctttggtgaatatattgacaagccaagcaaagcttaaggggattttttagtaaaaaaaaaaaaaaaaaagttaaggccgggtgcagtggctcaagcctgtaatcccagcactttgggaggccgaggtgggcagatcacgaggtcaggagatcgagaccaccctggctgacacagtgaaactccatctctactaaaaatacaaaaaaaaaaaattagccgggcgtggtggcaggcgcctgtagtcccagctactcaggaagctgaggcaggagaacggcgtgaacccaggaggcagagcttgcagtgagccgagatcacgccactgcactccagcctgggcgacagagcaagattccatctcaaaaaaaaaaaaaaaaaaaaaaaagttaaaaaaaaaagaggatggctaggcctttggcatggttgccaaaggtgtagtctccaatacccaaaagattttgttagtattatgtattgtgttagtattatgtattgttagtattatgcatttgttagtattaataggatcatttttcctattgaaatttctaattggtttttgctgaaggaagaaaagttgccaatctttatatgtccaactcacattcagcactcccgctaaactaattaattggttttaatcatttgtcaggttattcttcggattttccaaactgagcaattatggcctcggaaaataacaagagttttgtttcttcctttccaatttgtatttcttttcttgaatttgggctaagctgtgatatgggagatgtgatttgactttaattttgtggcaccgctaggcatggtggttcctacagtttcctggtttacatcctttaatagttcagggagttctcctttattcagttttctaggtgtttgtgtcatgaatgaatgtttatgggagctggacaaatggcaggatctactgtgaaaattatggggatttttttccccactaatttagtaaagcattgacaaattgacaatttgtccattttttgttgttgttgaaccaaccctagtggctcgagttatattatattattaataaattataggattcaatttactaatattttctttgtggtttttacatgtacaagtataatgatcctttgtgtgtgtttttttttcttatgctttccttatcttattttgataatagtgtttttactaacttcacaaaaggagttggtcagctttccatctttttctaaactctagaatagtttcaggggatttaggttatttgttccttaaatactttataaaaatcatcttttaaactctacggatttgttgcctctttggttattgatctttgtctatcatttccatttatctaatgattgtgtctctatccaggttttctacttgctcttggatcaatttgtttatatatattatcttagaaagttttcaacatcagtcattcttagtgtattggtataaaaatattcaattcttttataatttttgaaggttgatagtatccgtagttataaatccttttttgtttactcatgatatttatgtcttctctcctttttattgattatacctgtcaaaaatttgtctattgtgttaattgtgtcaaagaacttgcttttggttatgttgatgactggaatttctggccttctgtttcattaattcctgcttgtatattagttttcttcttcattctactttctttagatttttgttattcttttttatagtttcttaagttgaaagcttagctcatttatttttaatctttcttgttttctaataaatgcacttctggatctaaattcccctctgagtaccactgtggctttatcccataactttttatgtgcagaacttttacagtcattcggttttaagtactgtactccattatgatttcctctttaaaacgtgaattatttagaaggtttttttttaacctccagatgttatgcggggatatcctgtctatctttatgttgtcggttactatttttactccccggtccccattggaaaaaggacttgatgacttcagcctttgaaaattgtggatttttctttgttgcttagtacatagttaattttttataaatttccccatgtacttaaaactaatgagtatactcacttggatgtagagttaattaaattcttcaaatcctttattttcttattaattattattctacttgctatggtagcttttgagaactcatttcttgtggccgcggtaacaaattatcacagactcggtggtttaaaacagcagaaatttgttctgtccaagttctggaggccagaaatccaaaatcaaggtgtcatcagggtggtggtccttctaggggctctaagggagtctgtccctggccaccttagcttctggtggctgcccaccttcctggacactccgtgacttgtgccaacttattacaatgtctaccttccccttcccatggcctccccctctgtgtcaattctctgcctctctcttaaaaagatacttgcaatgacatttaggaaccacctggataatctaggatgatctcatctcagtgttcttaaattaattacatctgcaaagaccctttttacaaataaggtaatatttacagattccaaggattaggatggggacatgtctttggagccaccattcagcccgctacaggaaagatgtgtcaaaatctctccaggattgtcaatttctccttgtaattcaaaggaatggctgtatttcaaaggtattgtattaggtgcatacaacgtcaaaactattatatctccttcgtgcattttcacttgtattaatatgaaatggctgtctctgtccttaatacttttcatcttgagatctaatttatctgttggaatattgctacgttcttctcttttattaattttaaaactttctgagtcattatgtttcatcctgatttttatttcattgtttacgttgtcacaactgataagtttgggcttatttagccattataacatattttctctcttccccctgatttctctaggtttcctttcctcatatcttccctaaatctgaccagcggaagccacggcctggggtgttttctggttcagtcacaatttccagggtaggactgtattgtaagaagaatgcggtcactctccccaagcgcacattatcacacttcttttaagcaggagatcttaggactgtgtgagtggccagtcacatttccattttgccagaactaccattattcccacagcctctggaacaaaacctcttgctcgagaaggtgcttcagatgaactcactatttgaaaatgcatcttgttacgctgtttttttgttttttgttttgttataaataattaagttttgagggattctgcagatgcgccaaaaaacacgtgtccggggtaaaagctgtggaaggtgctcggttctaaggagagggaaggaaagccaagtggaccctgtcatctgaaattgttttgtcatccactgacttttacaaataaaacagccgggcgcagtggctcacgcctgtaatctcagcactttgggaggccaaggcgggcggatcacgaggtcaggagatcgagaccatcctggctaacacggtgaaaccccatctctacttaaaaaaatacaaaaaattagccgggcgtggtggcgggcgcctgtagtaccagctactcgggaggctgaggcaggagaatggcgtgaacctgggaggcgcagcttgcagtgaaccgagattgcgccactgcactccagcctgggcgacagagcgagactccatctcaaaaaaataaataaataaaaataaaaaaataaaacaagctgtggcagagtaggttctgaaagggtcagaggggacagtgtgctctgagaaagtgggcccacgaaggtaaacagcgctgccagcctgcggtgttgctttgccacccagggcaagcattcttggcacatttcagctgcagctgctgagctagtaaaatctgagaaaagaaggaacacagtgaataaagaagacagaagtgaaagaagagagcgcagccaagagaggctccagataaggccgcgatgctagggagaaaaggaatttataacacagagaatacacggcgctggggctttctcgcatttctgctatcgccgttaaaattatccgggttcaaatagagaaatgctctgtcctagtcattattcatgtttctttccaaggcacaaattccagcataggcaattttggcaggaactgaactatttatttactggattcttgcttacgaccaggcaagcagaaagccctccagcacgcacagaactggggctggcttcctctctccgatggctcctaggaggatctgcctgacccaaatgagtgccagctataaaatctcagcaaggccaagggcagaggcagcgccactcagcgagggaagccataaactagacagaaagacctccttgctccacactctcctggatcacatcctcaggtggagtttaaatcactgtgtcccagtttccacgtctgtgggcaggtgatccggcacccgcaaattcagagctgctggcatgaaaaccctataaggtgattagacacactggcttcaggagtgtttgatacagacaccacgttcgccgcccacgaatcgcccaacctcatattctgttttgctctgaatgtgccacagcgatccatcttccaggtccgatgggacctctctccagccccccgcccctgacctgaaccctcctcctggttttacttgaaatcacaaactcaagactgcccccactccccccaggtcctaggctgtgccctttatgattcagcccgagtccctgggctgctagtgaggagggcaccttgcttcccggccctcagagacgcctctctcccaggcttcaggcttcatggcacctggttatgaccttttctcaaaaggacctgcagatcttggcctaaaacggggaggagccccttggggagatgtagagggaacttgggtggagagcagagggaggaaggaagggtccctggggaaccagatcagctgattctgtgcgggaaatccgcagggagcgagcagtcactcagctgtcctaaaagccagcacagctcatcttccctctagaatttataactcttcaaaattctagccttgggccagaagtggtgggctcccacctgtaatcccaacactttgggaggccaaggtgggaggatggcttaaggtcaggagttggagactagcctgggcaacatagtgagacccccatctctacaataaatagatagatgatagatagatagatagatagatagatagatagatagatagatagatagacagatacagtctagccttgtttaggcccttctctctcagaacatttgctttgttgaagtgtgagcattccccagtaaattatgaaagttggttggctaagctggttcctctagacagctgctatggatggaatgcttgtgtcccctcaaaactcacgtgttgaactccttgcccccaaggtgatggtatttgggggtaggctgtggggaggtgattaggtcatgcaggtggactcctcatgattgagattagtgcccttatagaagggatcccggaaagctctctcagtctccttccaccatgtgaggacacagtcagaaggcagcgatctgcagccaggaagagggccccagccctgctggcaccctgatctcgaacttccagcctgcagagctgtgagataggtgtttattgtttaggccactcagtcagagacagaagctcaagcagacaaaggcagtgaccatgccacacagcctcccctgacccctggccctacgggaaggtcactctatgcatgcctgcactctctgtccagtgagccctgagtccctgtcttctctctgaggggcacttccagccccaagcccatgcaggacaaagatgatgggtatgtggtgcccccagggcctggcagcctcccctgtgcacagcagcaggtctgccctgtgtgccctggccctggggcccagtgttcagggcatctcagaggtcctgccttccgcaggactccttgccctacacaccaccagagggcacatgacctgaaaggaaaagatccatgtgtccagttgttcctcagtaaacatgtattgagcacctgctgtgagccaggcacaggcccagcccccaggatgatcaggcatgcagtgtccctgagctggggagccactgtctgtgaaggagactagaacaaacagctgaagcacagggcagcacggattccacagagcctcccacagcctcctcccatgtgtgcagggaaggcctggaagggggccaacagcagccaggcaaggagacccaagcctcccaaatacaccaccaggccccacccttcaggttcaaggagccctgggctggtcaacagccaaacatctgccctgctttgcatggtggattcaggtcaacaacacaccccgttggtgtgcacgaccagcctcagccaggcttcttgtacagcgcctcgatgtccagtccaaaccaggccacctcaagcccccaggccagaagcattgcagagaacatccttctcacctcctgggctgtccaaggggctgggtcctgccaggctccctggtttttcatggctccctgtgggtaagcaacaccttcttgcaaggacagagagggtcctgtacacgccaaagcttctcaaactccctgtgggcaaagaccaggttttgctttctaatctaccacagactgtcacttgtataaaatttaaaataatttttagaatagtgaaaggcaaaaagacatacaaaacatacgcctcaacagagtaaagagacaacttattgaatgggagaaaatatttgcaaactatttatccaacaagaggctgatttccagaatacacaagcaattcaaacaattcaatggcaaaacaaaacccaataatcccattaacaggtgggcaaaggatctgaataaatgtttctcagaagaaagataaaaacggcaaccggtatatgaaaagatgccaaatatcgctaatcatcaggaaaatacaaatcaaaaccacaatgagatatcatcttaccccagttagaatggctgttatcaaaaagacaaaatatttaaaatgctgataaagatgcagagaaaagggactctgaaacacggttggtgggagtgtaaattagtaccatcgtggaaaacagtgtggaggtttctcaagaaactaaaatatccaatgacggacgcagtgaagctccctgacctgccacagtgcaatatattaatgtagcaaaactgcacttgtaccccatgaaaatatacactttttaaaacgaaaatatttttaagaactgaaaatagaactactataccattcagtaattccactactggggatttatccaaaggaaaggcaatcagtatatctaaaggataggatacctgaccccaatgtttattgcagcactattcacaatagtcaagatgtgcaatcaacctgcatgtccaccagcaaatgaatggataaagaaaatgtgatgtatacacaatgaaatactattcagccattaaaaagaataaaatcctgtcatttgtagcaacatggatggaactggggatcattatgttaagtgaaataagtcaggcacagaaagacaaatatcacatgttctcatttatatgtgtgatgtggtttagctgtgtgtccccaaccaaatatcatcttgaattgcaataccccaggtgttaagggaggaacctgatgggaagtgattgaattaggggacagttttccccatgccattcttgtgatactgagtgaattctcatgagctctgatggttttacaaatggtagtttctcctgcactctcacacacgtttctctctcctgccaccatgtgaagaaggtccttgcttccccttcaccttccaccatgattgtaagtttcctgaggccccccaagccatgtggaactgtgagtcaatgaaacctctttcttttataaattacccagtctcaggaagttcttcatagtagtgtgcgaatggactaatacaatgtggaagctaaaaaaagtggatcttagggaggcagagagtagaatgatatttaccagagggtggggaaacacggggaggaagataggttggttaatggatacaaacatactgtgatggttaatactgagtgtcaacttgattggattgaaggatacaaagtattgatcctgggtgtgtctctgagggtgttgccaaaagagattaacatttgagtcagtggtctgaggaagggagatccacccttagtctgctgggcaccatctaatcgcagccatcgaatataaagcaggcagaaaaacgggaaaaggagagactagcttagcctcccagcctacatttttctcctgtgctggatgcttcctgtcctcaaacatcgaactccaagttcttcagttttgagactcggactggctctcctatctccttaagcttgcagacagcctattgtgggaacttgtgatggtgtaagttaatacttaataaactcatatatatatatatatcatatatatgatatatatatgagtttatacatatatcatatatatgatatatatatgagtttatatatatatcatatatatgatatatatgagtttatatatatatcatatatatgatatatatatgagtctatatatatatatatcctgttagatctgtcgctctagagaaccgtaatacatatacagttctcgtgttcaatagcacagttgattgactacagttaacaataatctattgtatatttcaaaatagctagaagatttgaaatgttcccaacacaaagaaatgatacatgttcaaggtgatgaatatcctaaataccccaatttgatcattacacattgtgtgcatatatcaaaatatcacatgtacaccataattatgtacaaatatcataaaatgtacatatgcaggtaaatattttgcccttagcttcaacggatataaaattactctatcaagttgctacaaaagtttctaaacactctccatttcagcacttatctcaccacagaaagtaacaaagagttcttggactggcatagcccgtgaactacctggaattgtgctgccccggactgagggtcagcaaactcctgcccaagggcaggccaaatccatcatcttgtcatttaagtattgtctgaggctgcctttgggctttcgtgctacaaaagcagacttgaaacaaccacttactaaatggccttttattgaaaaatgtttgccaactcctgccctagtctacttcaaaaacactgcccacccatctcagtacctccagtcttcccaaagccacagctgcttacctcctccagtaaccatgagagaatttcttcaataacgacaagaagatagtatttaccaagtagatcagcttcctagggctgctgtaacaaattacagcaaagggtggcttaaaaacagaaatttcgtttcccacagttctcaaggccagaagtccaaaatcaaggtgtagagatggctgtacttcctccaaaagctctaagggaaacaccttccttccctcttccagtttctggtagctcctggtatttcttggcttctccctgcatcaccccaatctctgcctccatctccacatggccctcttgtctatgtctgtgtcttctcttctaagtccgcctgccattggacttagggcctatctggataatccaggatgatctcatctcaagatctttaaattgattacatctatgaagaccctttctccaaattaggtcacattcgcaggttccaaaagttgcaacattgatactatggtttgaatgtttgccccctccaaaactcgtgttgaaacttaatccccaatgtaatattgttaaaatgagaggcctttaagaagtaacaccaacatggtacatgtacacatatgtaacaaacctgcacgttgtgcacatgtaccttaaaacttaaagtataataataataaaatttaaaaaaaagaagtaattggatcatgagggctctgctccaagtcattaacgggttaatgaattaatgggttatcactggagtgaacctgttaaaaagccagtttggctctcagtgagcctctcttgccctgtgatgccttcaccatgttatgacacagcccaaggccctctccagaagccaaccagatgcagccacctgatttggacttcccagcctccgtaactataagaaataaatttattttctttataaactacccagtctccattattcagttacagcaacagaaaatggactaagacggtggacatatcttctgggtgggggcacggttcaagccacgacactgagtgtttactctgtaccagacggtgttctcattctctaatctcaacctcacagcacctttatgtggaaaacactgtcctcattttacaaatgagtaaatcaagtccccaagaagaatccacatataattttccaaggattacacaatgagacagaggtaggattcaggcccatacccataaccactgcaacctgcagccctgagggtcttgggagcattcactgggtgctctgcgtgtgtcaagcagcagtctcagcactctgcacatatcatggccccttaattctcataataaatatgggagattgccgttattattattattattactttatagaggagaaaatagagatttagtcttaaagactaagatcacccagctaatcagtggcaacattagggcttgaacctaggtctattggaaaacaaagccagactcatttctacgacactaagcaaaactttgtataacagcagggcaattcccaaactcaaactccatcagcctcagagagtaagcccatgaagttatcatgagccactgagattgtcacctcctatccttgctgagtgagtcctgacgggcctcagggccccaggctcccttggtcctgtggctcagacttcaccaggccttcaggtcttgcgaatccagccagaagatggggaagaggggaggagagtgacacactcacttcttaacttgccttggaggtgacaatgcactctttttcacattccattggccagaactagacacatgcaagggaggctggggcactctacatcatggaaggaggcccccaaattttaagcagacaactagtcacctccctatattaaaaagctattttataaaaccttcgaaattctcagggttttggcacatagcagtaattcagtaattttttgaatgaatgattgaagctaactggggaaaaataaagctggctccacaagctggacagcagagctaccggagcagtaagtccgcagtggtcaggtgtagtgcaaagtactactggcctctatgaccctttcctacaaatgactaaaaggcacctcttctttaagacttccgtctatcataaaatcatcacactctactgatttttgttagaacaaggcaatttactgccatctgctggaaatgtaacatacacaaatccgcaatgtctgtaatgtgagtggtaactgccggcaatgggcaccattgtgcaatgcacaacctgcacaactgtacagagcagctctgagtgctgatggtaagaccagaggagcaacagaggaaagtgaggtcctcactgtgtggataagagtcctctgcatgtggggagaccgcaggatggacccaatggtgctgatactggctccttgtattttgcttgctggtggaggaaagatctgggggccaaggcaggggcacaggcctcctccgtcatcaggagggacaaacacctcttctgtacaggcctgggtctcaaaggccaattcaatagagttcataaggaaggcagaaactttatggttctcagtcttgctgacaagccaagaatgtaaattgcctgagagcaggggccacttccacaacatagggtcagtcagatgccccaagaagctcccagactcacacccctggagtgggccttgtcctgagccaggagggcagcctggccagtggatcactcccaccgggtgggacacattggtttcaagggattgtgccatactgggctcccggaatggtgctgatgtgctgacttgggaggattgctcacggcagacacgggacaagctcagggctctgagcccctgcagagccccttttgactctgggacaagagtcgagtgtgtgggtctgtgcatggcactcacccgtctgttctaattacagggccacctcggggccacagtgcttgtggagctcgggtggtggaaagcatccttaaccctggcaagcaaggaggttaccccaactcctttgcaggctctgtgttgcaccccgcttccaagactttccagaccagcagccatggggctttgggattgatctcctctcccatttccaattgatgcggtgatatcacactcatcacacctagaacaatttttttcttacattgttttaccccttttaaataagctttattttttgtatcagctttacgtttacaacaaaattgagcagatactagagagagttcccatattcccctaccccacacaggtacagcctctcccactatcaacctccctgattttaagttgtttattttgggggttttgtttttttgagacaggatctcgctctgttgcctaggctagagggcagtggcatgatcacagctcactgcagcctcaacttcctgggctcaagagatcccgtcacctcggcctcttgagtagctgggaccacaggacccgatagcaacactatacctggctaacttttttttaagagatggggtctccctattttgctgttcttgaactcctgggctcaagtgatcctcctgcctcagcctcccaaagttctgggattgcaggtgtgagccaccatgcccagctaagtttttaatttttttgttatatttttataaaagaaaaataacatcaagacacttcataaatgggtgcagaaaattataacaactaaacacttatatttagtcccatatacacatgtacaatggctggaacagacagaatgctatttttacaaaccatcaggttcttggacaatccaggatttctcaaggttcccagatctctgagaatacctggtggattatctctgggataacacacagaagctgtctgcaaaccttcagatggacttttttttttttaacttttatcataagttcagggggtattagtgcagatttgttatgtaggtaaacttgtgtcatatgggtttgttgtacagattatttcatcacccaggtattaagccttctacccattagttactttttctgatcctctctctcctctcgccctccaccctccaaaagcccccagatgaacatttttatagaagtaacgggaaatacagtgggaatccttgagttgtattttctagggtcagtcttaagctccacaggatgaggggaggatatttcttgcacccacagcccactcccaccacaccctgggcccctcatgattaacattcagcaagatcacatcctaggaatgcagcaatcagtgtctaaaagaaaacgtggctgggagatgtgctgctctacctttatgctataaaatctgtacatttaacatggtcagaaatgaattctcactcacattttactgctttctctggggaagacttgcatttgtggtcatcattgacagaacgcagtcatcatctcgaagagtgtctggaagccagggtccccgaccagcacaagggatgggacagtgtcatgagtaacggtgtcaccagccttaagtaaatggactggggacattcagaggcaagatgagctatgccatttcaatgcaaacagcttgcaaagagccaaagaggttatgagtgacaaccttaacgtaacaaccaggtgacatgtggaattgttttggaatgttgtctttggcaataaatactaggaagctatggtttctagatctgaacagaaagagatggcacctggggaggagaacaactttcacatgcctcaattggaaaacatgtaaatacataagtacctctatgctacttattattctaaatccttattgataaatcactatgccccacatgggcccatacgtcttgtcacacatttattaatcaaataattactacagacagagacctcatataagaatattttcctgggatcccacacaacctagggaaagcccaggtgagtaccccaataaatactgcttgaaggagattaggaaaagaaatgaatgggctcaaataggaaagttggaagaattcaagtatatacatcaggaggaaagggggggagggaaatgagttaataaaacaaataagaattgatcatatgtttcacatttaaaaatagttataattgacccggcgtctcatattttggatagaagagaagaaattcagctccacaccttgtcagaaaaatatagcattgagattcagaaaatacacacacagccggggcatttccctttccaataacgtgttactagttagagtcgacataaccaatagaaacattaatataggtttaaacaagtgtatctcctaggcagatccttaaattcctttaattttacattaggatataaaatcgctcattctaatgggttagtaaatgcatatagtccttcagaagcctcattgatgaaaacacagcacaggcagagggaaatagactgttatttctgctctggctgtatttccatttcctaataacagtaatgaacttgaagcatcgtatttgcacacaaataggtctagattccagtttggctgcagctatacagttaagcgtgtcactgatgtgcacttcccagcctcaaaacacaatttaaagatcactttatggagagtcgaattacagcaatgtgcttaagcattagggctgtggtatttctaaaaactgttggcaacagggccaagttctatggctcataaaagtcgatcacaaagttctgagctactgcagctcattgattgtggttatcctttaagtttcttaatgttcccacccatggtatactggcacccattccatttctcaagctttgacactgttctttccttccttccccttctccttgctcacacgtttacaaacgactgctctgggccatgcccaggtagagtcgtgcacaggtcctaccctccagcagctcagaatgtgcttaggccgacgcgaaaacaagtaagtacaatgtgaatattgatgcgtaccagtcaccatgaaaacacagaacggggaacacctgctgccgcccacctgaactgagccttcgtgaacatgagttcaacaagcaaaccatgggatggggggcaagaaatggcatttccagcagatataaacgaacacaggtacattttaaaacaaagcaaatgcaccaatgcacaatgtcctcaggaaacaggggcgtgataagcgggtggtgtggccagatggtaaaacaggggcggggctggaaagttaaggccggacgctgagtgtcctttactactaagcttaagagttcatactacaggcacctgggggccaccaagaggttttactggtctggctggttgttattgctgctgttgttgttgcttcgagtaagcggaagagatgatagcagtgtggaggacgactgtgacggggtagaaaggtgggtagtggaggccgggagagcagccgaaagtctctccctgcacttaggcacaaaaccccggttctgaatgaagcaactgcaggagaagaggtaagcagctggcttcaagtggtctgtaagcaggggctataccccgggcttggtgtccagatggatataaacagcaagaagaaggtgaaataacggcacaaaatttccaccccaaggaaacagacagaagctgatgccagtctttaaaaactcaggaatataaaaggaaaaactgtttaggagatcagaattaatttgactttggacgttacgtttgcatatccatagggagaagcccacaggccacaccgaggcagaagagactgtgggtgtagaatttgtgagggtcccagggaaagaggagaggagggctcaacaatcgggtagtggtcgtgtccaaggaagccgcagctgagaccctggaaggggaagcctgagttcaagtcagcatggagtgccaacaggctaagccaaaaaacatctcgtgctgttggcaaagggctggcccagaagaaagcgtcgcaggttatgtatgggcctcagcggaactgggccttcccagaaaagggagaagaacgaggtcacaggtgaagagaggaggtgctggcacctgtcagagtggaggcggaggacctgagatttgccttatcagatggggtgggatgggatgagctcaactgaagatgcaccaacaagataggcaccaaggccaggcacagtggctcacaccttaatcccaacactttgggaggccaaggtgggaggatcacttgagcccaggagtttgaggccagcctggacaacatggcaaaaccttgtctctactaaacattttttttttaatggtcgggggtggtggtgtgcccttctagttctagctactctagaggctgagatgggaggatcacttgagcccaggaggttgaggctggagtgggctgtgattgtaccctcaattccagcctgggaaacagagtaagaccctgtctcaaaaaaaaaaaaacataaaaataattaaaataaaatatttaagaagatgggcacctaaagggcaaatggaaatgagtctggaattcaggagaaaagtcagaggaacagggacaactacactggttcccagagtagtttaaagaaaaggtgttctggatgtataatcaggaagaaaagttgcatttttcagcaaaatattgacatcaagtatttaattctttcttcatatataataaagataccaaggaaatctctttgtgaatctatatgatttcagttttaattttaaataatatttagtaataaagaaagtactcagatgattataaactaataatcatttttcaaaaaaaaaaaaccatgttccaattaattttatgtagatgtggtttatactgaatgggctgtcttggaatcaccagggaaggccagcacgggcaccaggaaagctaccataggtggcatttaccttggtgaattctccatggtctgatgctggcctctgactgggcaccccagaagcttgatctgtagagtatgactcatgctaacaaagcaatgatgtctaaaactaaacctggacttggcagttcacaacagaaatacaatcgtcaaatggcctaaataccctgtttagtgtagccactgcattcttcctctatggggaaattggggaggaaaactatgaaaaggttacctggggagcaaggagccggttcccatgagcaacctggtctctacatgtggtagaaacaggctggtagaaatagggggttttggtggggttttttgtttgtttgtttgtttgttttttagtcagggtctcactgtcacctagtctgtaatgcaaaagtgtgatcatagctcactgcaaccttgacctcctcctgagcttaagtgttcctcctgcctcagcctcctgagtaggaactatagacatgcactaccacacctggctaattttttttttttttttttttttttttttttttttgcagagatagggttttgccatgttgcccaggctggtcttgaacccctggcttcaagccatcctcccaattcagcctcccaaagtgctgtgattacaggcatgagccactgcacctgacaggctgaggatctaatgcacccagaacccccaggtcacccacaacctaccctttgccctggacatatttgtcttcctatctccttactctttgttccacccctgactagatctctgttttctttccactgaatcactccctaaatcctgtactagcacattcatcttcaagagtcttcagtgctccgtaaagccagcagaataaagctcagatgcttccacgtggctgagaccgggccacttcccagactcaccacctcccacatcagtgcacatgccccatttaccacaggtggttggtgcttctcccactctgtaagctttgagttctcatttctgtgaacttgtgttattggttcacattaactatgtaccttcactgtgcaggtaccatgctagagtatgcatatctatttgtgcatccagtccccaaccctgggaagtccgtaccatcatcatacccacttgacagatgaaaacacagaggcttggggaataaagacacttgccatacagcaatcgagagaggtgcaagcctggagtctgcgtgctggaagattccaccacacataactgcttcccaaggcactcacacatggtctgcacttcacagtgtttgtttatcaatacacgaagagtttatatttgtactgtggaaaaatgtggatcagaataaagtaagcaacatcttaaaataaaataccttattattttaaagaacaaacatttttgatcgggcgcagtggctcacgcctgtaatcccagcactttgggaagccgaggtgggcggatcatgaggtcaggagatcgagaccatcctggccaacgtggtgaaaccctgtttctactaaaaatacaaaaaaaaaaaaaaaatagctgggtgtggtgacgcacgcctgcaatcccagctactgggggtgctgaggcaggagaatggcttgaacccgggaggcggagattgcagtgagccgagatcacaccactgcactccagcttagcgacagagcaagacaccgtctcaaaaaaaaaaaaaaaaaaaaaaaagaacaaacatttttgaacaagtagtaaatgagatcaagactcttacctaactttaaaacctagttgagtttgtcttcttcagcataaatgccggctctaccacaaaattgctgggtgaccttgggcaaattgattaccctctctgattcatgttcttcatctatcaaatgggagtaatcatcatgtcccatccattcttcactgatgaagtacccagataacctgggtaccactggcacaagcacttaataaataccagctattattattctacactatgtcctaaagacattgtttattttgtctgaattttaaagtggaaaatccggctgtctttgctcaagcctatttttaaaactcttggggaaattgtaaaatataaagttattaaattaaattaaaatcatgagcttgctttggtcgggtggccaatctttttgttttcttctttgtgtctctgtaggaagaagggcgccactgtatgcctgggctgccatcagcagcattgactcattgctaaaagaggggaaagctcaggactctaaatcctgaatccttcagacagtcctgccatttcccaaacattgcaccaacatcatgaaatactttaaaatcaataaaaatgcatgtggcagaaggcaattattcatacattatctgaaaacaataaaggaagatataccttccattcaattttcaggattatatatattacaggtgagtatttttagcagacttttccccctttctctctttttgctccaactgttagtttcatagggtcagagagagttcagttgtatagagaaagtactaactgctgaatggctctgtcaggctcctgtatttaaggagacagaattgcatattacaagaaaatgattgttcagctaccttttcattaacaatttgtctacaaggagacaggcttaactgcttctattgaagttgggaagcaacaaattgaatgtgttccataaggattatgtcatacttcaaacatatggtgagctacaaacaccaagatatcgtatttggaaatagtggtgggttcactattgtttggtggctgtttaattgaatagtcataaataatactttttttaaaaaaacttgtcatctgcataatctcaagtgaaatactgtaataattttcttttatatatgtttttgatccttgacacattaaagaaaaatgtcttttctttaggggaaactacactgaaggttattaaggaaacatcagctataaaatgcatcctaggtcagcttcttgtaatggggttccactttggagcacagagaagacatccaaaggtgtggaggggaaaaattctagctgagcccagggttgatgcagaagagctttccctgaatgcaccccgagattgaggtcctggggtcaataggccaaccaggcttccttctgcctctgtctactgaacagaaaatctagtccctccacctcccacccacaatgttccaaactgaatgctcgacattttaacacatcaagtgacaacactaactttagacacttttagaaagcaccatgtcagtgttgggttgtcatcatgtatatggccagtaagtccacaacaggtcaaagccctggaaccccagccatggtttcaaggagtccaggtttattatgtcgtgtctgtgacacatgtctccaccaggaaacccactcttgctcagtaatggaatattattcatgaatgctcactgtatataaagttcataggcttaatgccaaaacaatattctgttttcctacttaatagaaagagatcactaattactagtgcagaaggaaaaatacctaattccacacagaacaaaggatacccatggaggccatgctgggcaaggctggctccaagtgtcagctacaggtgtaaatgcattgatagagaggaagaaggggaaggttgttttctaacaagtttttaaaggttgacctgactgttgttaagattacgaagaaagacactggaacagtcattctcaactcttcaaactcaatgccctctttttataacatgattttgtacatacccctttactgtcttgaaatgtaattcatataaaagataatctaagacaatactcattaggatggctactattaaagatacaggaaataacaagtgttggtgaggatgtcgagaaattggaacccttgtacactgttggtgagaatgtaaaatggtgcaaacctccctggaaaacagtaaggtagtccttaaaaaattaaaaacagaattcccatgtgacacacatcccacttctgggtgtatatccaaaagaattcaaagcagggtcttgaacagatgtttgcacagccacgtcaatagcagcactattcacaatagccaagaggtagaagcaacccacatgtccattgatgaatgaatggataaaaagaatgtggtatatgcatagcatgcaatattatttagtctttaaaaaattctgttacatgctacaatatgaataaaccttaaggatagtgtcctaagcgaaataagtcagtcacacacaaaaaaactaattctatatcattcctcttataggcagtatctcaaggagtcaaattcatagaaacagaaagtagagtggtggtggccaaaggttggatgggaagggtaacagggagttgtttaatgagtataaagtttgcaatgagtataaagatatgcaagatgaaaagacctggaggtctctttcacaataatgtgaatatgattgacactactgaactgtatgcttaaaaatggttaagaagttttaaatatagatagctacagatagatatagatattaacctgttttatgttactataacaaaataccataggtaattagtaaagaaaagaaatttatttctcacagagccctcgtgacctaatcacctcctattatgctccagcctctaaacacatttgcattggggatttccaacacatcaattttgggagacacattaaaaccatagcattctgcccctggcttccaaaattcatgtccttttcataatgcaaaatacatgcatttcattccaatagccccaaaagtcttaactcattccagcaccaactcaaaagtccaaagttcagtcttatctgaatcagatatgggtaagactcaaggcacaattcatccccaggaaaatccctctgcaatctgcgagcctgtgaaattaataaactgtgtgcttccaaaatacagtggtgagacaggcataggacagacattcccattccaaaagggagaaataggcaagaagaaagacgtgattggtcccaggtaaatccaagactcaacagggaaaacatcaagtcttaaagctaataataatcctccctgactccatgtcccacattctgggcacactgggacaggggctggacctgtaaggccacaggcagccctgcccctatgattttgctgggctcagcccacccggccactttcatgggttggagtctcatgcttccagctttcccaaactgaagttgcatgtggatggccccacagttctgtgatctctgagatggccttactcccataggtcaactaggcaatgtggcagcttggaccccacatttcggctcagcattgccctagtaggggctgtctgtgttgtctccacccctgggaaaagtttcagcctgggcccttgagctgtcaaatacatcctttgaaatgtacagaccccacagtttttgcattctgttcatctgcagagtcaacaccacatagatgtcatcaagacttactgcttgagccctctggagtggtggcacaagccatacccggacccatctgagccacggctgggacagctgaggagtgctgtgcctgaatgcagggagcagagtcccaagcatctctgagcagtgaatgttgaagtcccacggcaaccttcctggaaaccttctctggaaggccctgttctgggcctgtgatgggaggggcaacctgctgagcccatcaaatgcctttgatgtcttttccccattgtcttgatgaatggcacctggctcccttctatccatgctaatctctttagcaaacagtctcttggccacactcttagtttactctcctaaacatgccttttcactctttacatgaccaaggctgctcatttcccatatattttgttctgcttcccttttaattataaatgccatctttaaatcatttctcttcattcacatcttactatatgtggttaaaagtagctatgcagttcctccagtattttgcttagaaatttcttccaccagatatccaagttccttgctcttaaattctacctcccataaagccctcagttgtggacatgattcagccaagaatttataatagttctttgtgaatttataacaaagatggcctttactccagtttccattactttgtttctcatttccatctgagatctcatcagattagcctttaccatatcagaaatgttcatatttctaccagtattttgattaggaccacttaagtaatctctaagaagcttcagactttctctacaagtctctccagaatcatgcttaatggtctgttcacagcaatataggctgttgcttgcctgctcctccacattttcccagcatctagccattacccagttccaaaggtgcttccacattttcaggtatttattatagcaacagacctacttctcagtgccaatcttctttcttggctcattttttgtggctataacagaaaaatacagactgggtaatttataatgaacagaaatttatttggctggtggttctgcaggccaggagtccaagagcatggcatctgatgaggacttttgtgcagcatcatcccatggcagaggtgaaagggcaagaagtattgagagcaaaagatcaagagggggccaaaggttttgtaacgaagtcactcttatgataactaacccactcctggaataacaacattaatccagtcacgaaagcagtccttgtgacttaatcaactcttatgacaccctacctcccaaaactgttgcactgggggttgacaacacataaactttggggaatactttcaaacaatagcaatataaatacataaattctaacacaaatatgattttagaaataacacaataccccaactgaaataaaaacgtaaaaagaaatttatagtataatgtgcatagaaatgtacattatacacatttagcacagaaatgctcagaaaagccagcactggaggttgtaatgcaggagtcaggtgcttgctgctgtccttagaatcttcaagaacatgacagccacagaggcagacggacagggctgggctccactggtaagttaaccaccacaggtgactttctaactccagtgaagttccaagcaaaaggatttacacaatggtttctttcctggaaaatttagggtacatcacaactattggaatacaggtttacccacatgaaagtcccacagtacacttaaaaaattattcaatgggcaatactgccccatgaatgcaggatatagagtgttcccaggccatgcctactaaatgcaagcaaagcccccaagtctttgtcacaatcaaaactgcccctccaaattccataatatagcaccccccagggagaatcacccctagaggaagcagtgagaattgcctcactaaactatgagatccaaaaagaaaatcaaagaatgaagccttttattcagggctctgtcacctgccaatcaaacagctcagggcccaccccaggccattgcccaggggagatttcaccaggtcttagaacacaagcaaagattcatcttagcaaatccatctcagaacagaacacatggatatagggaggggaacataacacacccgggcctgttgaggggttgggggaaggggagggagagcattaggaaaaatacctaatgcatgcagggcttaaaacctagatgacgggttgataggtgcagcaaagcaccacggcacatgtatacctatgtaacacacctgcacattctgcacatgtatcccagaacttagagcaaaataaaaataaaaactccatctcagaacaaaagttggattttggttcttaatttttttgacattcatttatctcctcctacacatgttctctgtcctaaagaattgggtattttaaagttagctttctggagttttattttacttaagactcttgaaaataaaagtttcaggctcaaaggagcgaagcactaatggtgaaaactgatgtcctgttagatttctgagagaatcatctctggtcttcctgatgaccccaaataatcccatgcctggagccacccattctgccaagatcttggcactgattccggactgaacactaacgtccatgtattttcacttggtgattggcagctcccttcttgctttgttgcattatgcagctgcctggaggctcaactgagccaccactgctacaatggcacacccaccttctccaggttcctctggcccatagcacttacctgcattcagtggaaacagaaacaaaaggcctaaggaggaatgatgttgtcagaggtgttcgaaccaaagcgactccatcttgaatactggctgggtaagacaaggctgagatctactggactgcattcccaggaggttaaggcattcatagtcacaggatgagataggaagtcagcacaagatacaggtcatgaagaccttgctgataaaacaggttgcagtaaagaagtcagccaaataccaccaaaaccaagatggtgacaaaagtgacctctggtcatcctcactgctcattacatgctagttacaatgcattagcatgctaaaagacactcccaccagcgccatgacagtttacagatgccatggcatcattaggaagttaccccatattggtctaaaaaggggaggaaccctcagttccaggaactacccacccctatctctgtaaactcatgaataatcctcccttgtttagcatattatcaagaaacaaccataaaaatggccaaccagcagccctgagggagtagtctatagagtatggagtagccattctttcattcctctactttcctaaaaaacctcctttcactttatggactcaccacgaattctttcttgagcaagatccaagaaccctctctcggggtctggattaggacccctttccagtaacaatgtcacaaagaaaataatacttaaaacaccaatcagacactcattaacatattaactacatgtcttgcacataaggagaggggcagtgggcttcctcacaggaataagactgcataagaaagatgctttagaggttcttatgtcagccagttctccctgtactcatgtatttaacatacatttactgagcacatactgtgtgctggtactaaaacaaaaaacttattacaacaataagacccagtgcccatgtctacacagttccaacttggggtgccggctgccataacagagcatctgactgccgtaacatcatcttcaagaacactgagggtaggataaagacaggagttagctgttggcagtgaaaatgtccccaaaaataaaatgtctgagatcctgagataatgagggcaaaggggttttatgtgcctgcatgacagaaaacattaaaaactgtaagcaagttttgtgtctagacagagccaagtcgagtctaggaaccattatttgatacgcaattttctacttagcagcacaggtatgcagaattcaatttgggagtgatctgtattctattcagtttccacaatagcattaaaatgtactcaggaacaggggaatttatcttcctgcaaattcactccctaggggtcctgtagctcaccaatgggtttcagtgctagtgaggtgggcggcagaacagacaacagtgagaaattacagccacaaatcgcccgcatgaaccttgctgctggagctgctggcttctgcccgctcctgtaattgcagacccaaaaccactgccaaaaaagggataactaacctgcaaaaaaaaaaaaaaaaaagcttcgccagctaaccaaggaggtggcctcgctctagtctagagcagaaaatcttcttttctaacatatttccttgagctaaaacattttaccatttcaccacattttatcatttctaacatttgtattatgttttgcagtcaagttgtatttgttatatatggtagtatttctttgtttccctgccaaaaatactcttattaaattgataatgcattttacaatcagtgtgctagtttagaatcaaggaaattcaataattaccgtgatttaaaatgcctttccatagaacaactagaaacaaagctaagaggctaagcattgcttcccacacacatccatgtaatcaaatgtcttttgttcacatctcatcagccacccagaggttcaacttttggaagccccagggaggtaagtcttcccattaggcctaatccacaccaaagccccagcaaggcacgtcggctggccatgctttccctaggtagaaggcagcccgcctctcattagtcttagggtacactcaaagactaagccaggtggagtcaaaacccctgcactcatccccatattccaattgtcaattttaagaaaagtgtggccctggcaccctgacttctgcctttccacagccagtggggagagtgagttagatgtgccagggccagtgtttgtcccagcaaccccccagtgctatagacagctcagtagcagcctcctcattcagcaaacgtcatgaatacccaggaagaattatacatttcaatgattccattctgggatgtcgctagttcactgggaatccctcactgcttgatagttacctttaacctctcaagtacttgttcattgctccttcatggcttttaaatttgaggtctcccatctggggccccgaaggggctcactaagaaagaatcaatgatgataagctgtaaacatttcctttcaaagtcttgatcctagaacaaggtagaatgtttttcttttcctaaccactctaggatcttcacgaccagcagctaaatgtggaacaaggttcagagagctttaggaagcacaagaaacatcactagctctggcagacaagcctgcaaaggccaggggtgacttgagagctgagtcttggtgaatccacttaaggagctgttaatagcccagcagtaactcgaaactgccaagaagcgtccattctccatgggatcttgttgaagccagacatctgtcaccacacctacagtagcaactgtcaaagtgagcagtgagaagggaggaatgcaaaaagcagatcgtgtcaggaaatgcagttttactggtgggggggcgaaaaaaagctaaaggaaaatagaaggctaatatttgggagtcaaaaaacgccaactggatgctgcaaggtacacatggaaaaggagcctaggaacaaaagccacccagcaactaggagcagccagatggggctatcgcatgacaacaaatgtctatgtattaggtgctgaaatttagagatttacttgttacagcaactactgtggccctaaatgagattttgcatcgtccaggcgcggtggctcacacctgtaatcccagcacttcgggaggccaaggcgggcaggtcacgaggtcaggagatagagaccatcctggccaacatggtgaaaccctgtctctactaaaaatacaaaaattagctgggtgtggtggcgcatgcctgtaatcctagctactcaggaggctgaggccagagaatcgcctgaacccgggagtcagaggttgcagtgagccaagatcgcactactacactccagcctggtgacagagcgagattctgtctcaaaaaaaaaaaaaaaaaaaaaaagattgtgcatcaggtggggcacagtcactcatgcctgtaatcccagcactttggaaggctgagatgggaggatcacttgagcccaggagtttgagaccagcttgcacaacatagcaagaccccatctctacaaaataatttttaaaaaatagtccagcatggcagtgtgcacccatggtcccagctacatgggagctgctccatccaatgaagccatctgcatctagtcactctccagcccaaactcatgcctttccattattcctgaatctcatctttttctacaaatatactatgcatagatgtgttgcatgtgtgatttagatctttttatattgccttgctacactatgattgatgcataatcttttttgttgttcttaagacagggtctcaatctgtcacccagggtggagtgcagtggcataatcacagctcactgcttctcaaccacctgagctcaagccatccttccatctcagcctcccatgtaggtgggaccacaggagcatacaaccatgcttggctaattttttttcttcttttgtagagacaatgtcttaccgtattgctcaggctggtctcaaactcctgggctcaagcaatctgcccactggcctctcaaagtgctgggattaaaggtatgagccacctagcctgatacatgatcttttttttaatttaacttttattttaaattcaggtgtacatgtgcaggtttgttacataggtaaacttgtgtcatgggggtttgttgtacagattattttatcacccaggtattaagcctggtatccattagttatttgtcctggtcctctccctcctcctaccctccaccctatgaaaggccccagtgtgtgttgttcctctctatgcatccacatgttctcatcatttagctcccacttataagtcagaatatgtggtatttggttttctgttcctgcattactttgctaaggataatggcctccagctctatccatgttcccacaaaagacatgatctcattcttttttatggctgcatagtattccatggtgtatatgtaccacattttctttatccagtctaccactgatgggcatttaggttgattccatgtctttgctattgtgaatagctgatgcacaatcttaatgaaggtctctaagttctctaagcctcaatgtcctcattcataaaatgaagatactaatagcactttacaagtttgttgtgatcattaattaggaaggaggagttgggaacatgaacctggaacattataattcttttggatttgtttttgcctttttccaaagaataaaggctaagaatgaccaggaacttcaagaaggtaaatcaaatttaacatcactaataacaagaaattagcttgctagaaacagatatgagggaaataacacttttaaacacagctttgttctacataacagggggcattccatctttgagtttttttcttttttagaagtctttagggttgggtccagtggcaattgtgaagtgcaggatgtgaggtagaaaaactattgcttaaaaccagtttctcctctgcctgttgttcacatgctggtcttttccattaaaccaggcatatcctcagaaaacagccaggaactttctggaaggaaggaatgagagcagaagggatgagtacctcctccaggttgggttcctgaaaccttgcaagtggctcacctccaacattctttctccccttcctgctgactggagtgccaatatctagggtgaccttgaaagcaacaactgcaaagccattgtcatccaaagtccctgagtgaccacatggagcagagtcactcatgaacctgaagggctctcctgagaaccattacaaactctgatgtattattcagtgtctctgttttgagctctctttgttatagcaactggtgctaccctagctaaagcaaacttacccaccttagtatccccagtgcctacaacagggcatggctctgttcttaaggtgcttaatgaatagttgtgtcattgaataacccacatacagtatctatacctgggaggcaactctatccagaatttctcccaattgttggggggaaaaataagataaaataaaacatacacctcccattatgaagaaaaagataatctcataaaaaataagaatgctgatgtctgcaagtatctgttccagccatctggagggtacatacaatctagacaatatcaacgcctgaaatagatatcttcatttcttccccagacagtgtctcccttcctttaaggtgcaacgttccaaaataatttgaggaaacctcccctccaccactcattgcatggttgagtgagactgactccacctaccctgcctcattcaagatttatgttgcatctccctagccatagagattgatttggggatggtttgaggagtttggctagaccacaaagtctggccaaggtattaaaattgaatagaatcaaaggtgtgaactcagttcaagattgctttcacttctatatcctactgagatagcaaacagtgcaaaagatattcctaagataaagttacatgtacaacccatgggtttcctagatactgaaagaggcagaatcaaaattagaagtcagtgcagcctttgcagagtgagcaatgcatcaggttagagtcttcagcctggaattcatcacccagaattcatcattttatactatgaggtcggagggctgcatcagcagacaagggcctgagtactaccacagaaggaaactgtagctgtagtttcctattccctacactatgctctatgaggcactgggcctacagtaggcttggccagggcccatcacagtccacccctttgtggggatacagatggacagttctcatgcccaccttgtctaatcactcccagtgtcacaaacaactgttactaggacgcagcatcacacaaaaacaataatgataacccaaaactaaatagtatatgatactaattacagggtaagcccctgctcagaaaaggtcaattacacaaatctaccagtgagtatttccatcttgagcccattggagtatgtgaacatcatttatgaggttactgttatttgtccttacctgaaagacagcatcttgagttttcctagtgaggcttctgtcagtagaatgcgctttcaaaaaaaaaaaaaaaagtgtgttcttggagccttcagctgctcacagatgttgctgcccttctaagatgatgatgtcatgggatcagcagtccttgctgggaaccctgggctccaggtccctttggtgagcccagcccctccaccccagcatcctctgtcatctgaggaaatagctggagggaatcactagctacacccattacaataacccccaccaggagaacactacttcatgatccttgacctctctctgccactcagtctgtagtgggttgagtggaggcctcccaaaaattcatgtctaccccaaaattcacgatgcgaccttatttagaaatagggtctttgcagacacagttagttaagtaacttaagacaaaatcataatggatttctagggtgatccttaagtccaatggctggtgtccttacaagaggaggagacacacagggaagaaggccatgtgaagatggtggcggagactggagtgatgcagccacaagccaaggaatgcctggggccaccagatgctgggaggatcctcctctgaagtcctcagaagaagcatgaccctgctgacaccttgaatctggactcctaacttccagaagtgtgagataataaatttctgttatttggtggcacattattacggcaaacctaggaaactaatatgaaatctgtcttagtccattcaggctgctataacaaaataccttagactgggtagcttataaacaacagacatttatttcccacagttgtggaggctgggctgtccaagatcaaggccctggcagattcggtgtctggtgaggacccgctttctgtcatttcctagatgatgccttctagttgtgccctcacatggtggaagggactagctagctctccaaggtcttttataatcccagtcaagagggatctcccctcgtgacctaatcacttcccaaaggccctacctcctgataccatcactttgggggttagaatttcaacttatgaattggggtagaggggatcacagcattcagaccataaggcagtccatatttcccagaggatcttctcaaactgtgtctgcctcctcagccagcagtgcctcagcaggcaccatacagccccaaatgctgcctcactggctcaggtccttgggcttccaccccttttgtttttcccctagagaaaagtggcaggagcagccaggtggctttatcccctctgccactccaagaacgagtctgacattctgtaaccataccacttcctcctgacagtgggaatcaaccccaccacctcaaaggtgccaggtaactcaaggggatgtgccaggccatccctaggaaggtgagtgctgtgaggcctgtccagagtccagtcttctctgaggaccaggcagcaaggtcccacctgcaaccttacagtgaggtggtagtgcagcctacagtcatttggggaaacattctcccacgctgctcatcaactgttcagcatgctttgactttctctgcccaaactggctatagccagtttgcctatgacaggagagggcttcagccatttaccctcagaggccaccttgtgaatggtcctttttattctgggcagtgggggtcaccctttcccctgccacagcagtctgctttccccttaggtcaagtcctgagatttttagccctccagggaggagtgtggccatcactcgtcgcctgggttaacagcaggcaagcctgtaagtttcacccagcaccttgagacacttacttctgaagcttgcagtatgaacctgggctgtatacccagcaacccagcatcctcacgaagaacaagtgagagtgcagacatgaggacatccgtgcagtgagcacacagctgcatcaaatcgcaccccgccagcccacagcctatggctttggagcagggccctggagtgaggtactacctcttgccacccctgggtgccaccaggaaacaccctccctccagggatgctcaggcagcagccgttagtgtaggcttatttctgacagacccagctgtaatcctagtacaggagccgggctggccacctcgcccctgccactggcacagcaatttcccctttccctacttcgacctggcttagacttctaagtctatcgtccttagatgatacacccactacaccaggagagggccctttccaactcccaggctgtttttgattgaccagatggacaactggatttgagcagaattcagaggtgacagcaataaacccacgattaggcaggggcagcacctgtgggtctgggctccacaccatgcctggacagtgcaattagaggagtgagaggcattgagatgatcctggtcctcaccaggtattaccagcatctgagcaggggctaagcagcaaattccatgtggtttcgtgtggcatggacatgactgggagcagggccagcctgctcctgagacccccctcatgctccagcatggctggctgcccctgcatgttggctgattcacagaagagcctggattgtgcccaggatggcaggtcccatttgctaggctttgtccccatgactagagggcaggtgtcctccaagtttcacctccagaacctattccaagatagttgttcctccctccactcctggcccaagggaaggtgtgctgagtgctcaggtgactcttccatctcagcaaacccccttccacaggccctcatgcccccatagaggaccccacagtgcctgcagctcaggaccctcaaatgccctgggctccagtcaggcctcccaggagacagggctcttgcctgtatttccctctttcctcattttccacataaacttgaagttcttcttatcaatacttttaactatgccaaaagctagccctaaccatgctgtctatccaggcttaaattttggcaagaataaggccagggtcttattgaagattgctttcactttggtttatcaccaaaccagccaacaagcagtggtgagtacacatgagataaggacacaaaggaagtcgagacgctccccgcggccccacagtctctcctgaagatgggcctaacgtcatagtcagcatctgcatggagtggcatggggtgagcattgcccaggtcacagacgctcagagccttgggctccaggaggccaggagaggggccatgtcagcaccaagggttttcttgccactgtaaagagggccatcactgcactcatgcttcctctttcctggtctagttgtcccagagcaggcctgtacaacctcccaccatacatcataaaagtgacagagaatacttgttaaatgctacatgcatacgtatgaatgcactgaatcattacagcaattgttattactcctattttccatatgaggaaactgaggcacagaaaaattcagtgacttgcctagtccagctctcctcaggcatggagaagagggacaagtgagtcctccagctgttagtctggggcaccacagcatgcatcctgctttcagaaatctcctgatccaaagacgtgctctttcccaatcttcttgaaatgcccctaaacttcaggaagttatgtccaacattctctctctcatgaagtaaaaagagggctgctgaagtcagccaacaaatttggcccctccccagtttttgctttgacgtccctcccctagtagagagaaggaatacttggtcctttcggtttcctccacaatcttcatcttccctggcaaagtttccactgagcccacccactgaacatggccagatgatagccacaggtctgagcccacccatcgaacatggccagatgatagccacaggtccagctagctgtttgaagcctcagatgactgccacaagtaaaatgatgccctgcggtccagcaagggtaaagccttctccagagtacctcttccagaatgttctcataaggttgaacctttcctgggtacgctacgagctacccgagcaatgcaagtgatcaccaggagtggctggcaacaggagatagggagacaggaatgtttgtgttaaaacaccccccaagagattttgacagcaacccacccctgggtaagctccaggaataaaaatgtgaaatctcaccttcccaatctggtcttcgtattttttacttttttctgatgatagaaaataaaatatactcattataaatttttaaaattaaattaaaagtgaataaagtagaaagtggaaagcctctaaagtctagcctcctcaaaaaaaaatcctcaagtaatagatgggtgcatatcttctagagctttctatacctacataaatagatgtaacattgaccacttagccaagctatcatgtgtcttaatgttccagcagtaacatgggcttctaacacattgaaaatgtaaattaaccattatagatacttaaggtgagttgatttttataataatggctggcttctgtatttttccctatagttttgttctgctatctccagcacaactcttcctgttcctacatctccaagcatgaggtaacagttctgcatgagttggtcaggtgacacagattaaactggcccaaccatgtcccagatgacaggaatttgttctgaatactgggatgtcacccgcctgggtgcttgctttagtgagatgacagcatgataccctcaggttgatgacaagtgatggtgcttattgttcaagagaacagatccaggtgtcttgggtgagggaaggaggtcctagaatccagaaattccaggaagtctcttcttcccctattaaaaaacaagtgcacaaggtttgacaggattcatgtgatggccatgggcccagcttggtaaaagcctgccctggagaatctaatgggtcagcttagggagataccacagtgcaatctatgaatcaggaagcaggccctcaccagacactgaatctgctggtgccttgatcttggacttcccagcctccagaactgtgagaactaaaagtctgctccttatgaatcacgcagtccatgacattttgtcatagcatcaaaataaactaagataccgcctctcttgtgtacaaaacctgcctatggacctctcagacctccatgaattccaggctaagaacccctgcctttaattagaggaaaaaatattcagcaattctctgccatcccacacagttgcccaacttttcctgggttaaagtgcactattataaaaaaaaaacctgaaagatgaagaactaaaatgaagaaacagctctcactaggagaacaccccatctaacatccataagtaagacatgttttatctgtacggttgccatttatttttctaacttaggtaattcatctgaacatatttttcttttcatttccagtcagtatatgaaagaagttttagcttcataattttagttcttggggaatttggtaaaacgtactagccatcatattcttgggttgaatcttctccatagcaataaatctcagaaaaaaataaaagaaagatgatgcactgcatcatttctaattccaatactatttctggtttaacatatgacttttaggtctttgttaacatttttgtctagctttgtgcaaatagatgggaaaatatctaatgtggtacaaaaatataactgtaaaataaaagctctaggtaaagccataagcaggaataatcagctacaaaaatatctctcaagttgaataatagagttttagctcaactatcaattttgaatacaattacagcccagtagttagcagatcattcagaaatggatattttactgttctacttttcaaattacaatgtggaacttttagcaataaagggcagtttgaagaagtgaaaagtcataaaatgggaaatggaacatatctagcaggagtaaggggaaaagggaagtgtgaggagcgtttaatggggctggcatcactatggctttaggaagagaatcacttctgatctgaatgtcccaagagattgggtaataaaggaatgctggatgagttcaatttaaaaaaaatagagtaaatgctctgaaatgaatattgaggagaaaaatgcacactatgtctgctaaaattaaaattagtattggtaaattggaatcatcaatagaaaaatgctatgccaactgcaatttaaggatatgaccacctggaagcaaatacatactcaagacaagttcattaaagtgattatttctctaaatctggtaaaattcctatccagaagatattccctatgctccaagccaaaacagacaaagttgggctcaaaaacatctcctatctcacacaagaaagaaattttaaaatttcagttcattgaggagggctgaagtctctgagggagacactatctctaacctccaatgctctgagcaaacctaccatttgctccagaagaagacagcatccctatcttgccatacaaacagccttgaaaagttggtccagaacaaaggctgtcagtgctgcttttgcaaagacattcagaaacgcaaatgacaattgcactgacacagagtcctcttcaacagcaataggtgtcagaagacaatggaacaatatcattgacgtaataagaaaaagcttagaattttatcccctcaagagtgaaggcaacataaaagtattgtcagataaatgtaaccattataacgagctatcaaaatttggggatatatggctgggtgcagtggctcacacctgtaatcccagcactttaggaggctgaggcaggcggatcgcctgaggtgaagagttagagaccagcctggccaacatggagaaaccctatctctactaaaaaatccaaacatgcacacctgtaatcccagctactcagggggctgaggaaggagaattgcttgaactcgggaggtggaggttgcagtgagctgagatcacaccactgcactcaagactgggtgacagagtgagactccatctcaaaaaaaaaaaaaaagtggggatataatcataaagcaactgaaaattactaatttctgcttctcattttccctttaaaactactagtcgacaagtccttctacttctggataaaaacagccctgtgaattttctgctcactgtgagaatgaaaaacttttaaagacctaaatcacaaaacaaaacatcaatttcacattttaaatattcaataagcatcaaaattcaaagtttgattcccagttgaagtttttctccctcccccaggtcagggtgttgcaggtgaaaaacttgtagtcaaggaagagggtagcataggctcttctcctttccccagctgtacttctatgcctcctccctaaatatggcttctgatccctccaggtcaagcagaaaaaagaagaggcaagggcagcaggaagtctcccactgactagtatggggaagtgagctagcatctgtgctctcagggttgtgcaagtgtttatatctgactctttttgtcatggtgctttcaggggtcttctgagacttccctctgccatccataaaaactattcatgaagttcccttgatgagcatgagtcttttccagcaggtaaagaccctttcatgtccatcaagagaactacatgagactttcctgctcatcaagggaactcctggagaccccttctctggtctctaggaatatggtgagacctccattttctctcttcttggagacaattttcctctccatgtggcctcttgggcaagacttaaaaggccacacactggctttcttaggtatatagtccatatctagtccacaaaatgcattcaaacatcctttgcctccacaaactctgggaaagtaatgatcttccaaagacgccctctcccttgttgccaaaagccacattagcctgtcttagcattgcagtatcaccaacctgactcagtcaccatctattctatcttccaaaatgcaaggcattcatactactctttttggcagtcctctcaaaatgcttcttaatttgcagttaggaagttatttaataaggtacagcactttccaaaagtaaattatgatcttcaaaactcttcatttgatttttattcttccgtttcttgttctctccaacttctttataagacattgattagtaatcaaatttgaatagagtcaaatctgaatgagtagaaaagttggttttctgccattttgttttacagtcctttggaatatagcttgtgtcatcttcatggctgggaaatgttccattttaccaccttgttacacatcaggtaactcttcctgaagagctatgtattcaagcaggaaaaaaaaatgaacccacagagaaagccttgtatacaaggaacagaaattgataatgtcaataaatttaatcattaattacctcaaagttactaatactgccatttttaaaaaggatgggagttcccagttaaacatgtgaattaaacagatttatttatcttgatttgctattaaaactccactatagggacaataaagacatttttaaggtcataaatacacaaggacagtggggaaggcaatgacagctgaacagagatatcaacaaaatatttgaagccagaaagcagatgtatgtgtataacgaatttaaaagagcaacggaaactgaaattgatgtgcttatgagtgagaacatgaaaaagaagcaagctgattcaatacacacctccaaagacaggaattgggggcacctttgccgacagggcttggagacaaggatgaaaacagaaaacttggttggaagtctttaaaaaggcctgtagacatgaagtttctctttaaccccagataaccaggcaactctacctcccttacattggcagtacactacagctttgcagctctgacctcagtggcactgctgaaaacagaggtgagacccctactgaattaggggattcagtgcaagtgtaagtcctgagttgagaccagcctccttctccatttatctatcagattgctggaagtaaggtttctgaactccagtaagggacaagggtaacccaggaaaagtgacagcacagtagcaagatctgcagacactgacatttgaaggctcccagtgaaatgaccatgtcactgcatactcaccatgaagtcaacaagctccgtcaatgcacagagtcccaattaccccatcttaaaaaatgagccaccagtttttcctaagaaaactaaggaggctttccttatatatttagagatccttgtctagtggtttatatttattgctacagtaaccctgcatggcaaataaccaccaaaccttaccagaacaaggatttgcttttcttttccacagatccacaggtcagccatagttgagctaggctcacctgggctcagggggacactaggcactagaaatctctgccacgtgctctttctcaaaggctgcagttgccgggcgcagtggctcacacctgtaatcccagcactttgggaggccaaggcgggccgatcatgaggtcaggagttcgagaccagcctgaccaacatagtgaaaccccgtctgtactaaaaatacaaaaactagccaggcgtggtggtgtgcgcctgtaaccccagctactcaggaggctgaggcaggagaatcgcttgaacccgggaagtggaggttgcagtgagtcaagattgcaccactgcactccagcctaggcaacagagtgagtctccatctcaaaaaaaaaaaaggctgcagttgatacagtataaatcaataaaaggcaaaacataaaatctagcaaagaaaaaggaaattcctaggatgctaacagttggaagtacaagcccaatagctgtaatgcaataagaatagagtggctatagtcaataataacttaactgtacattttaaaataactcagtgtaattggattgtttgcacctcaatggataaatgcttgaagatatcaatacatgtgattattatggcttgcatgcctttatcaaaacatctcatgtaccctgtaaatatatgtacctactatgtacccacaaaaattaaaaacataaacaaatcacaggaatagaaagcaaacagacctactggaacaggaagatagggcttattttaacagtttgaactaatggaaacttgaaataaaaggcctttttataaaagagctggttgagagtgtggaaagcgaggaatgagaaaagatgcaagggaagaagaaaacaaacaattcctaatagaaggaactaaaaaacgcacaggaaaggaaacggaatcactaaaaaattatttggctcatctgtgaacaggatttacatagctaaaataaaacgctgaatatgcgaacccttctatccctaaatgtggaaggtggaggggaaattatatataaacctaaacatgtaatatctataacctcatatatacataatcaacattttacagagagaagatgtgacgaggggaaatgcaggcatgtgagggttgtataatagtatggcaaagctaaatcctgatctttcatagtataaagtcaacagtaataaaactgtaacctaaaactgaaaagccaagaaatagcattatctgcatcatatttagaattatagagggaaagacatgagaaaacagcaacaagaatagaaagtgtttgctgatgggagtggtaaaagatggagaaaaggaacacctttttcattatataaattatgcaaaatgctaattgccttatgtaaaaattaaatttaaaaaaagcaaaattaaaaccccagacaaaagtaataagctgggagggtatcaatgagtaagcaattttttgttgttgttgttttactagggaggaggaagaaaatacagaataattctaacctctgttagaaaaatgtatagtcggaggtggctggcaagatggctgaatagggacagctccagtctgcagctcccagagagatcaacacagaaggcaggtgatttctgcatttccaactgaggtacctggctcatctcattggaactggttagacagtaggtgcagcccgcggagggcaagcagaagcagggtggagcatcgcctcacctgggaagcacaaggggtcagggaactccctcccctagccaagggaagccattagggactgcaacgtgtactccagcccagatactacacttttcccacgctcttcaccaccgacagacacgagattccctccagtgcctacaccaccagggccctggatttcaagcacaaaactgggtggccgtttaggcagacatcgagctagccacaggagtttcttttcataccccagtggcgcctggaacaccagcgagacagaactgctcacacccctgaaaagggggctgaagtcagggagccaagtggtctagctcagtgaatcccacccccacataccccagcaaactaagacccactggcttaaaattctcaatgctccagcttggtggagggagggacatccaccattactgaggcttaagtaggcagttttcccctcacagcataaacaaagccaccaggaagctcaaactgggcagagcccaccgcagcttggcaaagccactgtaaccagactggctctctagattcctcctctctgggcagggcatctctgaaagaaaggcagcagcctgagtcagggacttatagataaaactcccatctccctcggacagagcacctgggggaaagggaggctatgagcgcagcttcagcagacttaaacattcctgccttccagctctgaagagagcagcagatcccccagcacaacattcaagctctgctaagtgacagactacctcctcaagcaggtccctgaaccccatgcctcctgactgggagacacctcccaccagcagtcgacaggtatctgatacaggagagctctgactggcatctggcgggtgcccctctgggatgaagcttccaggcaaaggaacaggcagcaatctttgctggtctgcagcttccgctggtgatacccaggcaaacagggtctggagtggacctccagcaaacactagcagacctgtagcagaggggcctgactgttagaaggaaaactaacaaacagaaaggaacagtatcaacatcaacaaaaaggacatccactcagagaccccatccaaaggtcaccaacatcaaagaccaaaggtagataagtccatgaagatggggagaaagcagcacaaaaaggctgaaaattgccaaaaccagaacgcctcttctcctgcaaaggatcacaactcctcgccagcaagggaacaaaactgcagggagaatgagtttgatgaattgacagaagtaggcttcagaaggtaataacaaattcctccgagctaaaggagcatgttctaacccaatgcaaggaagctaagaccctgaaaaaaggttagacaaattgctaactagaataaccagtttagagaacaacataaatgaactgacagagctgaaaaacacagcatgagaacttcgtggagcatacacaagtattaatagccgaatcaatcaagcggaagaaaggatatcagagattgaagatcaacttaatgaaataaagcatgaagacaagattagagaaaaaagaattaaaacaacaaacaaatcctccaagaaatatgggactatgtgaaaagaccaaacctacatttgatgggtgtacctgaaagtgacagggagaatggaaccaacttgcaaaacatacttcaggatattatccaggagaacttcaccaagacaggccaacattcaaattcaggaaatacagagaacaccacaaagatactcctcgagaagagcaactccaagacacataatcatcagattcaccaaggttgaaatgaaggaaacaatgttaagggcagccagagagaaaggtggggttacccacaaagggaaccatcaaactaacagcagatttctctgcagaaacgctacaaaccagaagagggtgggggccaatatttaacattcttaaagaaaagaattttcaacccagaatttcatatccagccaaactaagcttcataagtgaaagagaaataaaatcctttacagacaaagaaatgctgagagattttgtcaccaccagacctgctcctgaaggaagcactaaacatggaagggaacaaccggtaccagcaactgcaaaaacataccaaattgtaaagaccttcgatgctatgaagaaactggatcaactaaggggcaaaataaccagctagcatcataatgacaggatcaaattcacacataacaatatcaaccttcaatgtaaacaggctaaatgcccaaattaaaagacacagactggcaaattggataaagagtcaagaaccactggtgtgctgtattcaggagacccatctaacatacaaagacacacacaggctcaaaataaagggatggaggaatatttaccaagcaaatggaaagaaaaaaaaaaagcagtggttacaatcctagtcactgataaaacagactttaagccaacaaaaatcaaaaaagacaaagaagggcattacataatggtaaagggatcaatacaacaagaggagctaactatcctaaatatatatgcacccaatacaggagcaccaagattcataaagcaggtccttagagacctgcaaagagacttagactcccacacaataatagtgggagactttaacaccccactgtcaatattagacagatcaacgagacagaaaattaacaaggatattcaggacttgaactcagctctggaccaagcagacctaataggcatctacagaactctccaccccaaatcaacagaatatatattcttctcagcaccacatcacacttattctaaaattgaccacataattggaagtaaaacactcctcagcaaatgcaaaagaacagaaatcataacaaacagtctctcagatcacacttcaatcagcttagaacttaggatgaaaaaactcactcaaaactgcataactacgtggaaactgaacaacctgctcctgaatgaccactgagtaaataacaaaattaaggcagaaataaataagttctttgaaaccactgagaacaaagacacaatgtaccagaatctctggcacacagctaaagcagggtatgagggaaatttatagcactacatgcccagaagagaaagtaagaaagatctaaaattgacaccctaacatcacaattaaaagaactagagaagcaaaagcaaacaaattcaaaagctagcagaagacaagaaataactaagatcagagcagaactgaaggagatagagacacaaaaaacccttcaaaaaatcaatgaatccaggagccagttttttgaaaagttaacaaaatagatagaccactagccagactaataaagaagaaaacagagaagaatcaaatagacacaatgaaaaatgataaaggggatatcaccactgatcccacagaaatacaaactaccatcagagaatactataaacacctctatgcaaataaactagaaaatctagaagaaatggataaattcctggacacttaacaccctccgaagtctaaaccaggaagaagtcaaatccctgaatagaccaataacaagttctgaaagtgaggcagtaattaatagcctaccaaccaaaaaaagtccaggaccagacagattcatggccgaattctaccagaggtacaaagaggaactggtaccattccttctgaaactattccaaacaatagaaaaagagggaatcctccctaactcattttatgaggcgagcattgccctgatacaaaaacctggcagagacacaacaaaaaatagagaatttcaggccaatatctctgatgaacatcaaggcaaacatcttcaataaaatccagcagcacattaaaaagtttatccaccacaatcaagttggcttcatccctgggaagcaaggctggttcaacatacacagatcaataaatgtaatccatcatataaacagaaccaatgacaaaaccacatgatatctcagtagatgcagaaaaggcctttgataaaattcaacaccccttcatgctaaaaactctcaataagctaggtattgacggatcgtatctcaaaataataagagctatttatgacaaacccacagccaatatcatactgaatgggcaaaaactggaagcactccctttgaaaaccagcacaagacaaggatgccctctctcaccactcctattcaacataatattggaagttctggccagggcaatcaggcaagagaaagaaaagtgggtattagaataggaaggcaggaagtcaaattgtctctgtttgcagatgacatgattgtatattaagaaaatcccatcgtctcagcccaaaatctccttaagctgataagcaacttaagcaaagtctcagaatacaaaatcaatgtgcaaaaatcacaagcattccaatagacagccaaataatgagtgaactcctgttcacaattgctataaagaaaataaaatacataggaatacaactgacaagggatgtgaaggacctcttcaaggagaactacaaaccactgcacgaggaaataagagaaggcacaaacaaatggaaaaacattacatggtcacggataggaagaattaatatcatgaaaatggccatactgcccaaagtaatttaaaaattaatgctatctgtatcaagctaccattgactttcttcacagaattagaaaaactactttaaatttcatatgaaaccaaaagagagcctgcagagccaagacagccctaagcaaaaagaacaaagctggaggcatcacgctacctgacttcaaactatactacaaggctacagtaacaaaaaccagcatggtactggtaccaaaacagagatatagaccactggaacagaacagagccctcagaaataacaccacgcatctacaaccatctgatctttgataaacctgacaaaaacaagcaatggggaaatgactccctatttaataaatggtgttgggaaaactggctagtcatatgcagaaaactgaaactggacccattccttacaccttatacaaaaattaattgaagatggattaaagacttaaacataagacccaaaaccataaaaaccctaaaagaaaacctaagcaataccattcaggacataggcatgggcaaagacttcatgactaaagcaccaaaagcaatggcaagaaaagccaaaattgacaaatgggatctaattaaactaaagagcttctgcacagcaaaagaaactaccatcagagtgaacaggcaacctaaagaaagggagaaaatttttgcaatctatccatctgacaaagggctaatatccagaatccacaaagaacttaaatttacaagaaaaaaaacaaacaactccatcaaaaagtgggtgaaggatatgaacagacacttctcaaaagaagatatttatgcagccaacaaacatatgaaaacaagctcatcatcactggtgattacagaaatgtaaatgaaaaccacaatgagataccatcttatgccagttagaatggcgatcattaaaaagtcaggaaacaacaggtgctggagaggatgtggagaaataggaatgcttttacactgttggtgggagtgtaaattagttcaaccatcgtggaagatagggtggcaattcctcaaggatctagaaccagaaataccatttaacttagcaatctcattactgggtatatacccaaaggattataaatcattctaccataaagacacatgcacatgtatgtttattgtggcattattcacaatagcaaagacttggaaccaaccccaatgcccatcaatgatagactggataaagaaaatgtggcacataaacatcatggaatactatgcagccattaaaaaaaggatgagttcatgtcctttgcagggacatggatgaagccagaaaccattattttcagcaaactaacacaagaacagaaaaccaaacactgcattttctcactcataagtgggagttgaacaacgagaacacatgaacacagggaggggaacatcacacactagggcctgtcagtgggtgggagggcaggaggctaggggaaggatagcattaggagaaattcctaatgtagataacgggttaatgggtgcagcaaaccaccatggcacgtgtataactatgtaacaaacctgcatgttctgcacatgtatgccagaaattaaagtataagaaaaaaatacatatagtcaattatagtttttaaaataaccactaaaaaaatggaaatataatctatggatttcaaaataacagaaaggttaaaggaagactatagaaaactttattgattcaacagaaagaggaaagcagcaagaaaatgggataataaacagaaaacagaagccaatatggtagtaataagtccaaacatgtcagtaataacaaataatgtaaataatatagtcgcttatcaagaaagagacttacagtttagatttttaaaaatttaacttaacctacctaaaggtaggattgacagcaaattagagtgtttagcagtggtttttgtgatgcctgaggctatactcattcttcttaaattacctagaatggcaaagatcagtaagtggcctttggcccttcctcaatacatagtaagagcagagatgctgataccccaagaaacaagagcttaaaggccaagaaaagtcatttttttctttttttttttttttttttttttttttgagatggagtttcattcttgttgcccaggctgcagtgcaatggcacggtctcagctcactgcaacatctacctcccaggttcaagcaagtctcctgcctcagcctcccgagtagctgggattacaagcacccgccaccatgcccggctaatttttgtatttttagtagagatggggtctcaccacgttggccaggctggtctactcctgacctcaggtgatccgcccacctcggcctcccaaagtgctaggattacaggcgtgagccactgcgcccggcccccttttttttttttttttttaaagactgagtctcactctattgcccaggctggagtgcagtggcgcaatctcagctcactgcaacctccacctccgaggttcaagcaattctcatgcctcagcctcccaaatagctgggattataggcacccgccaccacgtcctgctgatttttgtatttttagtagagacggggtttcaccgtgttggcaaggctagtatcaaactcctaagctcaagtgatccacccgcctcagcttcccaaattgccgggattacagccgtgagccattgtttattttttaaaagaaaacaaacttgaaaacatacattatctgaaggagaaggattatttaaaaagatacaaaaattttaaatagatgtaagtcaataaaaataagcaatgaggaaaagactccctattcaacaaatggtgaatggtgctgggataactggctatctatatgcagaagaatgaaactggacccccacctatcaccatatacaaaaattaattcaaaggccgggtgcagtgtctcatgcctgtaatcccagcactttgggaggccaaggcgggtggatcgcctgaggtcaggagttcgagaccagcctgggcaacatggcaaaaccctgtctctaccaaaaataaaaaattagccagttgtggtggcacatgcctgtgattccagccatttgggaggctgaggcaggagaatcacttgaacccaggaggcggaagttgcagtgagccgcaactgtgccactgcactccagcctgggcaatggagtgagactctgtctcaaaaataaataaataaataaataaataactcaagatagattaaaggctgggtgcggtggctcatgcttgtaatcccaacactttgggagaccgaggtgggtggatcacttgagcccagaagttcaagactggtcagggcaacatagcaaaactccatctctacaaaaaatataaaaattagccaggcacagtggcatgtgcctgtagtcccagctactcgtgaggctgaggtgggaggatcacttaaaccaggaatgcaaaggttgcagtgagccgagatcacaccactgcactccagtctgggtgacagagcgagactgtgtctcaaaaaaaacaaaagataaattaaagtcttaaatgtaagaccccaaactataaaaatctagaagaaaccctaatatcgtaatactcttctcaatatcggccttggcaaagaatttatggctaagccctcagaggcaattgcaacaaaaacaaaaactgaccaatgagacataattatactaaagaacttctgaacagcaaaagaaactatcaatagagtaaacagcctacagaatgggagaaaatattcccaaactatgcctccaacaaaggtctaatatccagaatctataagaaacttcaaactacagcaaaaaataaataaccccattaaaaagtggacaaaggatatgaacataacagacacttctcaagagaagacatacaaaggccaataaacatgaaaaaaacgttcatcaacactaagcgtcagagaaatgcaaatcaaaaccacaatcaaataccatgtcacaccagtcggaatggcttttgttaaaaagtcaaaaaatagcagatgtgcacgaggctacagaaaaaagggaatgcttatacactattggtaggaatataaattagttcagccactgtggagagcagtttggcgctttctcaaagaactgagagttaaactaccatttgacccagcaatctcactactgattctttacccaaaagaaaataaattgctctaccaaaaagacacatactcatatgttcacagcagcactattcacagtagcaaagacatggaatcaacccaggtgtccatcaacagcaggctgcataaagaaaagatggtacacatgtaccatggaatactacacagtcataaaaaagaatgaaatcatgtcctttgcagtaacatgaatgcagctggaaaccattatcctaagtaaactaacacaggaacagaaaatcaaatactacatgttctcacttctaagtggaagctaaacactggctattcatgaatataaagataccaacagacagtggggactacttgaagagggagagagggaggaggcaagggttgaaaaactactgggtactacgctcactacctgggtgatgggatcaatcataccccaaaccccagcatcaagcaatatacccatgcaccaaacctgctcatgtatcccccgaatctaaaataaaagctgaaattattttttttaaaaaagaaagaagatttagaaaaaaagaataaagttttccatagggaaaaatatatagaagtcaatttcttccttatgctatacacaataataaattttgggtggattaaatatctagctgcaaaaagcaggaggtgttttccccaaggaaaatttctaaagtctatgtaggcagttgcctgctcagactagaatgtatgtcaacaattcagaattacttttttgaagatcccaatctctaggtacatttttaactgtaatcaaacaactcatatatgaatgtaaatcttctcatttgcttataaccaatagcagagaaaagcttgcattggttttgaatcacagagctcgtgagtcagagataggagggttaggctgtgtaaggacgaaaaagtggtatctgctcctcacccattacaagagtcagagctgacactcctatagcaaaatgttaacaagaggaaagcatagcaaatgtatttaataaaaggtctacaggacacggaaaccttcagaaataaagaccccaagacccaggtgagaggtgaagctagctgggtcgggtggggacttgtgggtcaggtggggacttggagaacttttctgtctcacaagaggattgtaaaatgcaccaatcagtgctctgtagctaggattgtaaaacacaccaattagctctctgtggctagctagaggtttgtaaaatggaccgatcagtgttctgtaaaatggaccaatcagcacactgtaaaatggaccaatcagtgctctgtaaaatggaccaatcagcactctgtaaaagggaccaatcagcaggacatgggtggggacaaataaaggaataaaagctggccacccccgcccccgccccagccagcagcagtaacccgcccaggtcgcgttaggcagtgcgtaagctttgttctttccgtctaaacaataaatcttgctgatgctcactctttgggtccccaccacctttaagagctgtgacactcaccgtgaagatctgcggctttattcttgaactcagcaagaccacgaacccaccggaaagaaccatctctggacacacgggaaaaaccgtgtgtttctatgctaaatctgatgaaaggagtggatagttgtggagaaacacaattggataaaagggtatgacctaatgccagtatactaggcggaggggaggagaacctagcaaggcttgtccggatttttcttggcctctctgtgtgttgcattctttcccctggataggggacaggactcctctgtaatgagggttttctaccttcaggggagtggcgtctctaggttttatgacttgctttgcgggagagaagttgtttctatgacttacgcaggaaaagaggaattcttagggaagataagaggaagaaaggagagtgaggtgtcagaaggaccttgcttctgaggccctcccaatctccttcagttcaaagttttcagcacaccaaggttacatagtttggggtaccatgttttaagtccgaacagccattaagaactctggttctgggccaggcatggtggctcattcctgtaatcccagcattttgggagaccaaggctggctgatctttggagaccagcctggccaacatggtgaagccccatctctactaaaaatacaaaaattattcaggcgtggcagtgcacgcctgtaatcccagctacttgggaggctgaggcacgagaattgcttgaacccaagaggcagaggctgcagtgagccaatatcacgccactacactccagcctgggtgacagtgagaatctgttaaaaaaaaacaacaaaaaaacaaaaaaaaaaacacctctggttctggaaccagacatttttcaagcccagttctgccactgtcaattcttgtgaccttgaatgagttgtccaatttctttaagtctcagtttcttaattgttaatatggggataatagcagctgacagactaaatgagaaaatacccacaaaattcacccacagcccagcgcatcctgaactcaacaaatgttagctctcatcattgagccatgggagccaataaagacacatggtctcagatgttgtctggggtctgctgaggagcagaagctgaactcaagctctccaggccccctggggatgcacctttctcactctgggaatgctaccaagagtcctgatttgaaacttgtccctaattcatatggcggctgcccacctggccctgaagaacatccaacagatgcttggagctcaggccaggagtgtggcagccacctcctcctgggcccccgctgctctgtcatctgcccccacccccccagtctactcccaggtcagacttcccaaatcacagctttcatcaacgattgcaattctctactcaaaaacctgttccaggctggggaccgtggcctgtaatccgaatgccttgggaggctgaggtgggcggatcacatgaggccaggagttcaagatcaacctgggaaacatagcaaaaccccatctctacaaaaagttcttaaaaattagccaggcacagtggcacatgcctgtattcctagctactctggaggctgaggtgggaggaccacttaagcccaggagtttgaggttacagtgagctatgatcacaccactgcactccaaactaagtgagaccttaaaaaaaaaaacctgttccatcttgtcttgtgcctgatatcgaggggcttctatagtatggctccatcttactgaaccaatcttatttattcccctactccacatcatcaaacttctccttagaccaattactcttactccctgctctgtgaatatgccaccctcacttctgcctctcagcatttccccagcctgaagtctctcccaatcctctgtctccccaaactgatctagtagcataggtactgctagaacctataggcagaatgtctggaatctgtaacctcccgaaagcattaaaaagaataaaatctaatgtagaaccctctgcttttctttatttgtaaaatattagggtgtatatccacaatactcatcataccaaagcaaattagaaatggatcaaaaatttaaattttttatacaaaaaattggccgggctcggtggcgggtgcctgtagtcccagctactcgggaggctgaggcaggagaatagcgtgaacccgggaggcggagcttgcagtgagccgagatcacgccactgcactccagcctgggcgacagagcaagactccgtctcaaaaaaaaaaaacaatttaaattttttaatgcacaaaaatagttgaaaagaaacatgagcaaattctcttatgctctcaaagtaagtaaatcctttctaagcatgacacaaaattcatcactctacattctttatctgttgtcgattctttttcaccacccctcccttctaaagattcttcattcaatagagaagcaaagagcaccttgcccagaactctctccccacagcacccagtgtggttctgagttatcgtcctccagggagaggccctgtgggggatgagagacagacgagaggagacattattttccagagaggactgggaccagacgcactgggagacgtcagactggcgctcctggccaagtcctgagaagcaagtgcattgcgttgcgtgcggatacatgatgaaagcttcctagagattcccgggaatgagcatgtcggaaccttccactgcagggcttctggctgagatttttggtgccatcttccctgacctttcaggtttttgagtagagaactgcaatcattagccaggcgcaatggctcacgcctgtaatgccggcactttgggaggccaaggcaggcggatcacgaggtcaggagatcgaaaccatcctggctaacatggtgaaaccccatctctacttaaaagtacaaaaaattagctgggcgtggtggcgggcgcctgtagtcccagctactcgggaggccaaggcaggagaatggcgtgaacccaggaggcggagcttgcagtgagcggaggtcgcgccactgcactccagcctgggcgacagagcgagactctgtctcaaaaaaaaaaaaaaaaagaattgcaatcattgatgaaagctgtgatttgggaagtttcacctgggagtagactgggggatagggacagacaacagatgaaggcctgacttcccgaggccttccaaggatgtgtaagccctcactccttttattaaaacctttaacaccagaactacagagagtagcttctattttcctgaccaacgcctgtctgatacatttatcttttgggaatttatcctacggtactctcacacacatataaaatcacgtatatttaaaaaaaaaaaaaaaactcggctgggtgcggtggctaatgcctgtaatcccagcattttgggagacagagatcatctgaagtcaggagttcaagaccagtctggccaacatagcgaaacctcgtctctactaaaaatacacaaactagccaggtgtggtggtgcctgcttgtaatcccagctactcgggaggctgaggcatgaaaatcgcatgaaccctgaaaggcagaggttgcagtgagccgagatggtgccactgcactccagcctgggcaaaagtgagactccgactcaaaaaaaaaaaaaaaaaaatcattatttataatagcaaaagattggaaacagtcttaaagtatatcaatgatgggcaatttaaaatatcatgatgcatccataggacagaatgctatttgccgttagaaaggtacagcgcttcatgtagccatgtggactgatcttcaaggtagggggaaacccacaaaattcaaattagcttacattgtatgccactatttgtacaatgtgtacaataaacaaaggcacagaatatctcccggaatatacataagaaaccagtgagcctgagtgccttgcgaggaaagttatggaattgatgtccaagagtgggaggtagagctacgttactccgtacaccctttttcactcctgaaaattctatcatatggatatatttgccaaaaataaaacaactaattagttataagattacatgatctttatgaaatgccagcaaggcatctatagacagaacaacatactttcttccctttttttatttctcagattttaaatttcttcctgaaacttaaaacaaattagaaataaggaatttgaccttcttgttagagtatgtgggaataatgcctgttggccttttggaagattaatttcctacatccacttacactgcctaaagcatatgccccaacagatgagggagaagctggattgagatttaaatgcttccttgtcttgttccaatacaggattacttaaatttcaaatccatgcactttaacttattgagtggaagtgcctactgtcttctgggtaataaattctggagattgatttggttcttctcatatcttctaatttaaaaagaataaactaaagcagggataaccttgattacttgggaacaaagtccaattttttttaatttgccactactctcatccttgcctaaaaattggaagtccgaagtggataccctccactgaacagtgaccatttacattccaagaacactactaaggctggagctgaatatcatgagtcctaaaaattccagattcactattcacgatcccagagctgtaataaaatatctcacatgattcatcatataaatatcgctattttaactcttctgtaagaccttttctaactattccagcaaaagcctcttcttccttctttaaacccctgtaatattatatataattacagtaattattaatattttggttttatatcacttaaaaaattggccattcaccagtatactcaaatatatttagatggccactttttagtattattactattaatagtttctagactgtgataaagagaaattttctggctacttctgatagttccgcataaagaaaacagatatgttttcttctgctctgtataaaatatctcctgtctttccagttacatgtgtcaataactccacctgcctttttttacttaagtagttttgagctgggtttctcttgaaaaggcaggatccttgacagctcccactcccacccttcttctgttgaaccagaggtgcgtgcagccacacacagctctccttggagccattctcctcactcaaatcccaataaaatagtcccccaaacactgatgataacttctacacctcactttggttgttcttccttcaaattctgcctcaggtgccttcctggcttatccaagtgaaactgcaagggacctaaaccactttcaagcactgaaggaaaagggtatattgcaagagattagggttgaattgtgtcacccaaaaagatatccccatgacctaaccccaagacctgtgaatgtgaccttatttagaattatggtcctgctgggcccggtggctcacacctgtaatctcagcactttgggaggccgaggtgggcagatcacttcaggtcaggagttcaagaccagcctggcaaaaccccatctccactaaaaatacaaaaattaactgggtgtagtggtgcgtgcctgtggtctcagctactcaggaggctgagggggagaattgcttgatccggggaggcagaggttgcagtgagccaagatcacaccactgcactccagcctgggtgatagagcaagactccatctcaaaaaaaaaaaaaaaaaaaaagaagaagaagaagaaacagggtctttacagatgtaatcaaattaagatgaggtcattagtgtgtgtcctaaatccaacatgattggtgtccatataaaaagataagagacacagatacccacatatgtagaggaaagacaatgcgaaaagatgctgggaggatgccacattgcaacagaggcagcgattggagttctgcatctacaagtcaaggaatgccagcaattgccagccctcaccagaagcgaggagaggcacggatgggacagattatctccctcagagccctcagaaggaatcagtcctgctgacaccttgatcttgggcttccagcattcagagctgcgaaagaatgcgtttctgctgtcttaaggcacccagtttgtagtactttgtgacagctgccctgagagactcatacacaagggtgctgggctgccttctcatgctcaaaggcagtatgaacttgtccttgactatcacaagaccaggtggccacacgcagccaggcccttgagcactgcaggctgccttcttttcctctaggctctattcccccttccacatctgcttcattccttcctctctcaacacaactttccagaggggcaaggccattctgtcaacaactccatgctttgtctcttagaacttctgccactacatagagactgattcaactctgtaaacactgggtaaaaaaatctagggaagggcccaatttgggtcaagagccctcttcagccaaccagttgtggcaggggagacatgatcacactgcacaaaatagtttcttgagcaaatgtggcagaagacatcttccagaagcttcttgaggaaagggacaatgcttttagacttcggtgctaccttctccctcatatgcaatccttcccaagagttccctcttcaatctctccccaccccctcacacacacacacacacacacacacacacacacacacacatccttgaggtcctttgctttctgaagtattgttagagagagcaaacattcaaccatacaatggacaaaaatgtattccattctatagaatcttttaagctaatcttaactttttattatagcagtataccagactatattcttagaattttatcaataagctagtggaattacatgtgctaaaagttttttataaatcttattacttaaaaatgtatgcagcaggtatttctccggtcactatacctcgattttacaactgttgatggctgcccttgttcctggtttgtggttcatgtttgctcaagctaaacatgctctaaagatccactggaggactctgccttcttagtatcaattcttcctgctcatctgttgcagtccaaagcgaatggaactgacattgtggatctgaggctcaggcttggctctgatgaatatataacccttaccttactagaggcagccgagtggagagccatgaatggttttaagagaatccatcaccactactgacaaattaacttaaagcatgttcttctgacagagattcaatagcatcaccttttaatacaaagcacagctcagtgattggtgggcatcctcggatgtcagctctacttctttatttactgaaggacaaaacccaatacattgaattaattgatcacaccatacaactgaattctatgaggattttggaaattttccctaccgttaatattgattagatcagtcaaaatagactagattatgccacagtaataaacaattccaaaaattcattaactttaaacattatttctcacccatgcccacaactattgcagattggctggaactctgctccatgtcatctgcattcaggaacacaggctggctcacactctaccatctggaatgtcacagattgcagtgacaggaggaagggaacacggcaaattgtactttagctcttaagggattgattctgcctagaagaaacacctgtcatttctgcttacatttaattggccacgtgagccacatgaccattcctacatccaaggggacatggaagtataatcctgccatgctggaatattggtgaatgtctggagtcctcatgtagctacaatccacctctccagtcaccaaatgatcagttcagtgtttctttcttgagcaaaattcatttattctctccccaggagagacaactcaaaagtctcattcagtcacggatcaagtacctctgggtaatgcatggtactatcttcatcaggagcatgttagtttgctagggcccccataacaaaataccacagaccgagaagcttaataaaactttctcaaaattttggagggtggaagtccaagatcaaggtatcttcaggtttggtttctcctgggtccgctcttcttagcttgcagatggccgtcttctcaccatgtcctcacatggcttatttttctgtgtgcatgcattactgatgtctcttcctcttcttataaagacaccagtcctattggatcagggcccccccacttatgacttgacttcatcttaatgacctcctaaaggccctgtctccaaatgcactggaggttagggctccaacatatgaatttggggggacacaattcagcctgttcaggtgatacccagtcactaaactgggcctgggtgtggctcctcttgttctggagagttatgcagtaaaaagacaagttacctaccccacacacacctaacttacaaagatgaaacagggaacagatgactccaacaaacattcctctttggaaagaggaaaaatgagagatatacagcagacactggcctttagcaactctgaaatagcttgaaccgatattgggaggtctaccctaggtctgaggatgtcagctcagcccttaaatacgctctgtgcaagaagcctcattctccataattctccatggccccagctttcttttccatcatactatctgacacatctaaagtaggcatcggggaatacattttgcttgatgtccatacagctttctcagaccacttccaaccctaaatgtttggtgatccaagggttcttttaagtctttaatacttggaatctcttttaattcagtctggtgattcctttggaggtacatctcttacaacaacttaatctacttcttagcattggatttcagaaaattccaggtgccaacagccacattcatggttcccttcaagacatattgtaatggataatattaggcatcaacttgattgaactgaaggatgcctagatggctggaagagtatttttctgggtgtgtctgtgagggtgttgccagaggagattgacatttgagtcagtagactgggagaaatagacccaccctcagtgtgagtggtaccatccagtttgctgccagcatgactagaacaaagtaggcaaaggaaggtgggattcgtttgcttgcttagtcttctgaatctttcttcttcccatgccagatgctcgcttcctttcctgctgcccttggacatcagactccaggctcttcagcctttggactctgggacttgcactggtggccactcagtgggtcttaagcctttggcctcagactcagggctgcgttgtcagcttccctggttttaagggttttggacttggactgagacacacaactggcttctctcctccagcttgcagacagtcatcatgggacttcaccttctaattgtgtgagccaattcttaataaactctggtttatatatacatatatcctattgtttctgtctctgtggagaaccctaatacacatgtcttatgtggatctttactctggtacatgttagtcttttcagaggttttaataatggtgtgatggccatggaaatatattcagttgaatggtttttaatagtagatatatagatcatgcccttctctgcaaaactcagttttaatattttttattgccaaatggttctctcaattttatcctatactgtttgaaatctaaaatcagattgcgcacagtggctcatgcccgtaatcccggcactgtgggaggccgaagtgggcagatcatctgaggtcaggagtttgagatcagcctggccaacatggtgaaaccctgtctctactaaaaatacaaaatcagctgggcatggggtgtgtgcctgaagtcccagctactcaggaggctgaggcaggagaattgcttgaacctgagaggcagaggctgcagtgagctgagatcgcaccactgcactccagcctgggcaacagagcaagactccacctcaaaacacaaaaaagtaaaaaaataaaaataaaatcagtcaacctttccaacattgcaattctgaaatgccccattaattcctgcttggactccagctgattctttcctgaacatgtcttttgtaataccttgtcaaatgcagccaatagaaaccaatgcacattactaatattgtgttttcctgcctctttccctagagctataaatttattagcatataatctgccttccaagtcactgtgggcaacgttttaaccaaagtttttgtctttcagactttataacagtttcttcactgcctaccacttgtcctgcaagccaatgacaaactgtaattttttgttatgttggcaccccactcctggtagcaatatttgtattagaataagctaaattatactagtaagaaacaaccccaaaatgtccatggctagaaataataaataattctttctgtctcaagttacatgttcattatacatcagctggtgggaagcacagagcagactcagctccacgtcaccttcactaattgatggagttaaccaaagactccacaacctggaactatcatggcaggaagaagtgaatttagttgctgcactagatctcaaagacttcttcccacattttactgaccaaatcaagtcacattgccacacctactttcaagaggttgggaaagtctaatcttacatgtgcctggaaaatacagtatcaaaatagtaaacagtccttatgtttatcaccgtttttttttttttttttagattgaggttcttaagaataagctccaaatgaactttccacaagactacacctaaaaagggaacaccaattttcatctgtgtttctacatgcgtaaggatacctaggaccatttcccgactgatcttaaaaatgcatgttccactggttttgagatgctatgtaaaaccagaattgtgtttcctaatagttttttttttttttaaggtgggtaaaaatttcaacagacttcttcactgcagaactactcaggagcatctcttggagccagaataccttgaaatacactttagaaaaaaaatggctttcattttgaaaaatataattcaataagtgaacttattctgtgttatataataagttttgtttctcaggtgactttaccctgagattggttcttgtggaagatacgatccatgatgtccaaagaattacctataactagagaagatctctctgtgtgttgtggagccagctttagcatgccagagttacatatgctgcacttctgtgacttaaggaggcatctgccggctagtgtaaaaagacttgatgtttccatatagataattatcccatgacagattctctatgctgtctacttctgaccatagatgaggcaactgtgtgagactgagcctcttctcttctacacaatgctgaggttgcccttttcaaagttctcttcccataaagattaccttaccatttgtattaatgagattttattcacttaacaatagaagaaaggtacacctatattccataacctccatgggcctgacccaaactcacctgtgcagcctcattgattctaacctactccacacatcttatctattactggaggctttcttggcttttggccacagtgtaagtaccatgtactggatttctctatggagcacaaggaggttatctactcacttaaagctagttaccattgtgtttatgactttagaaatgcacgactgatttatctcctgatactaaactgcattatgaacaacttaatgtttgacacattttccagaatgaatttcctctctttctgttgtcttgctttatttacttcaagaagaacatcgagagcttactcaagaaggataatgctccatggttatgtcttctctgggagttgcaaacaagactcagtcagcctgccaagcatatgcatatgggtattccaatgtgaaagagaagcttcactgatcagtgaacagaatgaaccacagctgctagtttagatctggctcaaatcagaagttgtgacttttgccatctccaagggctggttaaagctctgattcatgcatgaaccacccagtccatatggggtgggcaacacagcttgagctggaacattctattcaaattttattgagtccaggaaaatagtgcttctcataccaatccatcctcattttttgatgattacatgaatagatgaatagcataatttaaagctacatgcttttaatctctgaagatacaatcagatttgctttaggtaaaatctgcagacagctgcgaaaaatcacccttccaaccaaatgacccatctttatctcttttaaatgaaggcattagtctctggcagtcccctaccttgcattaatatgccctcaggaataagtcatcaagcctatgcttctcaaactttcccactaaggcacccctgacagacagtaaggtgtattagtaagaagagagtatgggtgtattagtccatacctgaaactgggtaatttataaaggaaagaggtttaattgactaacagttcggcatggctggggaggcctcaggaaacttagaatcattgtggaaggcgaaggaagcaagacacatcttacatgatggcaggaggtggtggaggggaactaccacactttaaaaccatcagcttcagctctcgtgagaactcactcactatcacgagaacagcaagggagaaatccacccccataatcctatcatctcccactaggcccctcctctgacatatggggattataatttgagatgagacttgggtggggacatagagcccatagagccagaccataccaaaggtagccaaaagggaacccactccatttctgaagagggcagaattcctctgaagaagttcctcttttatcttcttttttttttttttttttttttgagacagtctcgctctgtcatccaggctggagtgcagtggcatgatcttggttcactgcaacctctgtctcctgggtgcaagtaattctctacctcagcctcccgtgtagctgggattacaggcacctgccgccatgccccaccaatttttgtatttttagtagagacagggtttcaccatcttggccaggctagtcttgaactcctgatcttgtgatccacctgccttggcctcccaaagtgctgggattacaggcatgagccactgcgtccggccccccttttatcttataaatgtaaataaattttgtgttctactctgtaaatatttatgattattttagtatgatattaaatactgactgaagtacatctatcactcagagtcaggtcaagaaacagaaaccatgcccattattttaacagaaaatttaatagaaaaagttgataaccacgtattggtgacctaaaaaaaatgtagaaagagggtactgaggtagcaatgcagaaaacaaaacaactaacacactagggctggggaacaaagggaagatttaaggattattaagccctggaagaagaaaggaggggcccctgagggcttggccatgtctctgaggaggggacatgaatgactggtgtgggtgtttctgtggggatcaatgaggctggttctgagcatgtgggaaaaactgcaatgtggaagcaaccgctgctactgaaacatctgttttttccagcgaggtaaacaattgtcactgggctttggggtcagtcagtaacaggaaacagaccagaagaaagagatcccttcctcctttttcctccaacttgctggcactatctagctccccctcttggcagaaccgaaaagggagcagctggtaaaacagaagtgtatttccagagtgtcagccacagtctcacaaagctaaaacacaataaagcaaggttgaagctgagaggcaataacttaatcatcagcccagtactcagttgttttccaataatagttctagttgaattgatgcaccatatttattcagcctatgccttcatatgcctctgccaaacattttacagacttgacaatgcactggctttgtctattaccagcctagcatgaattagcttagaaggcgtttagcaagggccaaggacaccagtattcccattccagttcagccacttttttatgacctgggacacaccactttctcagttacctcttattgaacacgagggagttgcatcaaattctcttcaagtctgttccaactttgtaattactggagattattatgggaaagctcaccttttataagcatggcttttgtggaaagggaagtccaaaacactgagatttctaagactttgttgcgcatccagacatagctaaagggtagggactgggaggaaaagagccttagaaaggagatgtgggagaaggaaacaaaagcgggattagaaaggtgctgaaaagaaacccacaggggtgttaaggggagagcaggtatgcagagcagaggagagcacctggcatttctgggatttggattacctgaattttgcttgatagttcatcttatgatttctggtggttgtgaaatgtaagctttgtgtgctctgtaattctgtgcagcaacaagatagaatggcacaggtctactcaggtgacagccaacctttcttttgtagtaaggaattagagtcccagtgttgaacacctaatcctctcttcccttgagggctgtaaaaatggagagagagacctgcacatcttgccatctgccacaaggcatttcttaatccaactcccttcatctagatgaaatactttgtgcttggcagaatggtgttatttcaatgtaatgtatgtgtaacctactcccttgccaaggaaagattgcttctaactagatcacagaaaagacaggtgtgaaccaaatgatagacaacatttcgccagactttgtgtgtttggtgttaatgcctgaatgctaacaattccccctagaactctcccttgaacttggttacaaaacactctgtaattaaatatcccctttaagatatcatggctaatttaatgagggccaaccccactataacagattgttaatctgagctggtagagtttttttctctttgttgcatcttcaagaatttttattactgtaagatagttggtaatattctttattaggctgatacgttttgaattgcttttcattttattatcacattagttccttcttaatggttttactaggactcagaagtctctggagttttaataacctctctttttttctgtacttatagtcatggaattaattttataaaatcacgatccttcactgaatatgtcattgggccaaaagaataaaattcaataagaagaattagaccttgaagagtgactgacgattcatcatgctactgatttttcactttgagactttcatttgctttgcagcagcacaatttctgttctttccacctctaagaatatactttaggctgaggaatactttggaattctttgaactgaggattattaaacttttttatataagctgaattttttaaatataggaaagtacatattcttactcatctaagaaaatacaactcttttgtagctggctttgtttaaagaacagataacaataaggtgaatttttaaaatcatcaaattatcaatcaaccagttttcttaggatcttattttcatgtttatcttccttgatccatagtggtagcaattctctcaaaaataaatatctactaattaaagtcctgagatcaaaactcctttattaaatataatttaattggtgtgaattaatattaaaagaacaaaatgtcacctataacatagtctgaaagaacaaaaattgtaaatcactttttaacttagccattgccaagcaatgagactatcaagtggaaatcagtagtcaaattttcaaagaggaataaataattaagtgcctgataacaatattaagaattgggtgaattaaaatcatagttacaaaagattcattatcaaacgaaggattatttcaggtgataagaaacttcttttacaggtatataactgaatacatacattgctgctacagtctctctggcaccagcaaattagaatattattacccttatgtcacaatttctcctctaaatctaacacataatggatgtgcaataaatgtctactgaatgaatggttttgtgcagttaatgggtttaatcagttaaaagagaactgagcttttcaaacataactccttggtcagacaaagccgcaaattttgcagcttgtcaattattgatggatttgatcttttaacaattcatttgggaagctgaattatctctaaagatatttaaataagtaaactattaaggtgataaccaaactaagacacaaactattaatatgttggttcttgacacatataaaactaaacacagattttaatttcttcaaaagcatcaggtatccaaatagcttcactggtaaaaatctaccaaatgtttaaagaagaattaacatcaatccttcacaaactttaaaataaacttcaaaaaaattggaaaggagggaacacttctgaactcataagcccagtattactgtgattccaaaaacaggtaaaaaagtcataggaaaagaaaactactgaccaatatcctttatgagtctacgcataaaaatcctcaacaaaatacaagaaaactgagtccaggaacatataaaaaaaatatttaccataaccaaatgggctttatcttaggagtatgagttgattcaatatataaaaaacaatcaatgtattaaaaatacactgtactacttaagagaagaaaaaaacaccatatgatcttctaacagaaacggaaaaagtatttgacaaaatttaacacccttttacaataacgatgtcccataaatcaggaatagaagataacttcctcatccactcaccacttctattcaacattgtataggaaattctagccaaggcaattagacaagaaaaagaaaaaaagactccagattagatgacataacgttatgtataggaaatcctgagagatccacaaataaactattagatctaatagatgtgtttagaaaggttacaggacaaggcatggtgccctatgcctataatcccaacactttgagaggttgaggtgagaggatcactcaagcccaggagtttgagaccagcctgagcaacatggtaagaccctatctctataaaaaataaaataaaataactagtcacacaaggtggcacacgcctatggtcccagctactcaagaggctgatgcagaattgcttgagccaggaggtcaaggttccaatgagctatgactacaccactgcacccaagctagggtgacagagcaagaccctgtctcaaaaagaaaaaagaaaggttacaggatgcaagatcaatatgcaaattgcatctctatacaccagcaatgaacgatctggaaaagcaatttggaaaataatttacaatagtatatatttaggaataaacttaacaaaagaagtggaagatttgtatgggaagcctacaaaacattgttgaaagaaattaaagacctaagtaaagggaacaacatccaatttttgtgaagcataagacttaatactatgaaaatctggttatgttttaaaaagtgtatagaaggttatagcagttaagcaaagatgaaaatgaaaactctaaaaatcatactttgattaaagtcacatctattttacttagggaaataatttttatcatcacttttctttatcatagagtgttaacacaaaaatgtatcacatcaaagctacatttctgtagggcaatggctaataaaatgaccccaaatatcactctatcttcctcttttgttaggataattataataaaatattctgcaattttttttcattagcagctaaatcacaagtattcttttgttattattattattattattattatttagagacaaggtctcactctgtcacccaggctggaatacagtggtgtgatcacgggtcactgcaacctcaaactcctgagctcaagcaatcctcccatctgagcctctcaagtagctggaactacaggcatacaccaccatgcccaggtagattttttttagcaataggatcccactatgctctccagactgatcttgaactcctggcctcaagcgatcctcgtgcctcaccctcccaagtaggcgtttattcattaattttgcgccactgactcccttttctcagcaagttttaccattttacaaaatattaatatttgatcagtgatgtttaaataaagcgccagccacagtaatgacactattttcagagacggagttcttttcttcagtttctgcaccttgcatctattgactgactcactgaaaattttacacattttacaaattttaccatttacacatactgtctgtgtatgtatgtgcctaattttgtaaaaacaattacaatcaggtcaaggaaataactgtaatctaatgttcattaaagtgaagatcgatctcaaaatataattataaaagtacagcttaattctctcataacctcagatgtacaaattgactacaaatctaaagaccaatcttttattcttccccaaaggcagtgaaaaagactaaagaggctcctgaaggtttaaaacactggaggataaaatttccattatgtttaatatcattctagcagtgatactctggatctgtgatagattttagagggcactgaacgtattggatttgaattataatgatcaaatctatcaatcattatcataatagatttcttaattaaaacacattataactataatggttataatacctttcttataagaagcctgcttttcagacttccatcactaatccatgtaaaaggagggaggcaacagatactattaataatatctccatttcatattttaaatagacagaaatgaaatgcttagcacaatgtcacctgacatcacaaacatttttaacactaggccaaaggagagagaaaacaagcataacaaactaagcatttggcacctgtcatttagggactaaaaatttctactctaggtcaaagattttacaggttgaatgtgaacataacagtactaaagttcatacaagtatctctgaactggaatgacatttagatgttactaatacaaatgggataaaaacactgaaaatgccctctttgaaacaatagcaatgaaaaatacagcagttcctacaaagtttaagaaagttgttcataagggccaggcacagtggctcaagcatgtaatcccagcactttgggaggctgagggagttcgagaccagcctgaccaacatggagaaaccccgtctctactaaaaatacaaaattagccaggcatggtggcgcatgcttgtaattccagctactggagaggctgaggcaggagaatcgcgtgaacccaggaggcagaggttgcggtgagccaagatcccgccattgcactccagcttgggcaacaagagcaaaactccgtctcaaaaaaaaaaaaaaaagaaagaaaaagaaagttgttcataaagacttgaagttggcaacaggagaattttttgaaaataaaggagataaagaaaaaaatatttagagctagcacatacctacatattttctcaccatcccactatctagcatacagtcagagagcttttttctgcaaatggaaaatttcacatgaatataggcaaattggaaacctaattcagtgatgacactattttcacactttttaaatttcttatggtattgataaaagatatatatttgtctggtagttgcctttatatatttatagtgcctttacacacctttcttcttaccattttactatctgcttttcagtcttcactggaatcctttgactgccacatattagctgtataataagcaatggtcttttaccattttcccctttctctcttttttcctatatcatggtgacatttttttcaactttgtcagaacctatgacttttgcatattttttctactcacatttccactctagttttaatcttaattctacaataaaatatattaaattggcatcattagtccttttgctaaaatttccctagttgtttgtaagtttgatgaagctcctcttctggtagacacgtcagaaaaggttcctgagtacagtattccctgagttcctgtacatgtagaactatttttatacagctttgattcttaatgaacagctcaactgaatgtagaattcttggcttgcactttctttccttgagtttcttaaaaatgttgcttcactgttactttgtttgtacactgctattgagaaagctaatgccagcctaatttccttacccttctaagtaatattgtctttttgcatggaggccctggggaattttttctttgtctttaaaatctaaaaattttactacactattatagcctagagttgattattccattccattgttccaggcatatcatgggccatttcaatatttagattaaggttttctcttatttccagaaagttttcttgaaatatagttttaagtattagacctgtttcattgttttatttttcttcttcttcaaatatgctttcatttattcttctttcttgaaatatagttttaatattagttccggtccatgggtggtagtaaatcttcttctctttctcctcctttgcttcctcctcctccttcttcctcagtatcatcttcttcatcttcattgtcttcttcttctccttccctccctcttcctcttcttcagttttacaaatgttagatttgctttgcctctcttccaattcattcactttctatctgacgctttttactcctgtctttatctcattatattcttggttgtttgcctacctgttatattcttggttgtttgcctacctttatttaatggtcttattaaaatttccaggtacaaatagcttcactaataaattttaccactgcttaaagaaggaataatagcatttgtgtgtctaattctacataaactctatcagaaaagagaaaataaggaaacactcctgaactaaaatggccagcattgccctgataccaaaacctaaaaaagacctttgcaagaaaagaaaactaaagatcactattctttatgaatataggatacaaaatttatcaccaaaatattagaaaatgaaatcaagtaatcataagaaagattattcattatatccaagtgcaatttatcttcgcaatacatggctagttcaacattcaaaagtctattaatgtcattcatcatgtcagcagactaaaaaagaaaacatgcaatcatcttgacagaaacagaaaaagcattttgaggaatgcttttaatcaaatgattgacatcaattcattatttgtaaaacctcagcaaactaggaatataatagaactttgtcaagctgataaagatcatgctcaaaaaaactacagctaaagttaacataaagcttcatggtgaaagattgaatactttcttcctaatacacgataaaaggcatggatgtcttctttccccgctcttatacaacatcaaagtgaagatcttcaccacggcaataaggcaaaaaaaaaaaaaaaaaaaaaaaaaaagaaggcgtacagattagagaggaagaaataaaactgtcccaatttgtaaacaaaattgtgtatattaaaaatcacaaagacagcttggccaacatggcgaaaccccatctctaccaaaaaatacaaaaattagctgggcatggtggcacatgcctgtagtcccagatactcgggaggctgaggtgggagaatcgcttgaacccagggacagaggttccagtgaactgagaccacaccactgtactccagcctgggtgacagagtgagaccttgtctcaaaaaaaaaaaaaaaaatcataaagaatctacaaaggaactactagtaagcttagcaaagtcatgctcaatatataaaaatatataaatatataagtatataaaaatcagttgtaattctatgtacaaggaataaaacaattctaattacaaactgaagttttttaaataccatttacaatagtacccaaaacataaaatacttaggtataaatccaaaaaaagtgcaagatttatatactgaaaactataaaacactgatgaaaaattttaaagacctaaataaatgtgagatagaccacgttcatagattagaagactcaatattgttcagatagcaattctcccggtttaatagatttaatgtaaaccctttcaaagtcccaaatactttctggtagaagttgataagaaatgccaatgaaaagacaaagcaatttcaatatcgaaaacaatgtttaaaaggaacaaagttggagatgcaccatccaatttcaaaatgtactataaagctgcaatacttaagactgtatagtattaaataaaggatagacacataaatcagtggtacaaaatatacagttccgaagtagactcacatttactttggccaattaattttcaacacagatgcaatggcaattcaacggagaaagaatagtcttttgaacaaatagtactgtaccaattgggtagccatatgcaaagaaataaaccttaatccatatcttatcccataaaaactaacccagaatgaatcataggcctaaaccgtaaaacctaaaactataaaacttctaaaattacacatagaagaaaatctttgtgactgtagcaaagatttcttagatacgacaccaaaacacaattcataaaagaaaagactgattaaatttgacttcatcaaaattaaagacttctgctttgcaaaagacactattaagtgaatgaaaagaaaaactaggctgggcacagtggctcatacctgtaatcccaacactttgggaggccgagacaggagggttgcttgaagctaggagttcaacaccagcctaagcaacaaagcatgaccctggtctctattttaaaaagagaaaggaagaagggaaacaaaaaaaaaaagaaagaaaagcccacaaactgggagaaaatattggcaaaacacattgagccaagcgtggtggctcacatctgtaatcccagcactttgggagactgacgcgggcagatcacctaaggtcagaagtttgagaccagcctggccaacatggtgaaaccccatctctacttaaaaaaaatttatatatacaaaaattatctgggcatggtggcacacacctgtagtcccagctactcgggaggctgaggcaggagaattgcttgaacctggggggtggaggttgcagtgagccaagactgggccactgcactccagcctgggtgacagagtgagactccatctcaaaaaaaaaaagtctgataaaggatttgtatcctaaatatataaggaattatcaaaactcaatagtaagtaaacgaacaacccaatttttaaaatagtcaaaagatctgaacagacacttcaccaaggaagatccataggtagcaagcaagcatatgaaaagatgctccacagagtatgtcattaggaaaatgaaaaatgagaccctaataagaaaccagtacatcaggacagaagggagaaaactaagaaaaccaagtgctgatgaggaagcacagcaactggagctgtcgtacactgcaggtgagattgccaaatggaacagcacactcaggcagcttggtgggccaggcccaggggcccctgctctgtgcagcctggggtggaattgtatggtttggctgtatcttcacccaaaatctcatcttgaaatgtaatccccataatccccacatgtcaaaggtgggaccaggcggaggtaattggatcatggaggcagtttcccctatgctgttcttgtgatcatgagtgagtctcacgagatctgatggtcttataagcgtctggtatttcccctgcttgtactctctctcttctgccctgtgaagaaggtgcctgcttctattttgctttctgcatgattgtaagtttcctgaggctgccccagtaacgcaaaactgtgagtcaattaaacctctttactttataaattacccagtcttgggtattcttcatagcagtgagagtgcagactaatacaggtagcaggcaagcatatgaaaagatgctccacatagtatgtcattagaaaaacacaaaatgaaaccctaataagaaaccagtacattaggatagaaggaagaaaactaagaaaaccaagcgctgatgagaatgcagagcaactggactgtcacacactgttggtgagaatgccaaagggtacagcacactcaggcagcttctcataacattcacatacaaccccacttacttacccaacgtcaacaaaaactcacgttcataacagaaaacctgtacgcaaatgtttatagtgaccttatccataatcatcaaaatggggaaaatccaaatgtttccctactggtgaatggataaacagacaggtacatccatacaatggaccgctactcattgatgaaaagtaattaacatgcaacaatatggatgaaactcaaatgcattataccaagggaaagaagctggactcaaagggcaatcacattctgtgtgattccacttatgcggccttatagaaaaggctaaactaattgcactccagcctgggcaacagagtgagactctgtctcaaaaaaaaaaaaaaaagaaagaaataaaaggctaaactatagggacagaaaacagatcagtggttaccaggaagtaggagttagagacgagctgacttagggggcacaatggaattttgtggataatggaatttgtctacctcttgattgtggtgatagttatgtgactgtatgaattgttagaactcacagcactgtaaaccaaaaaaggtgaatttgtctctatgtaaatcatacctcagtttttttaagtatatgactttcatattcttctgttaacacctggaaacattaaactaaaacattcctacatagcacttacataacttatcattatcaacctacactcagaagatatttctattttctcaggacagaatattggtttttctgaacaaacgattgaaaactgaaagcaaatactatcaagcccactttgaaactttctcctgctgtggggaaaaattgcctataaattgcaaatcactgtccttcatcattccccttcacacacaaattgagcagtaaaatcctctttcttgttttaatttcagcaatagttcatttgcttctgggaaagaattcatcataatcaatctgattattttcatgtttgctagcagtttgcatgatttgaccaatagtcatatggataatttgaaatatgtttgttcatatcagtctaacaataatccattatgttctgtagcaaagtaattctttatgcctgaaaaaaaaaaatcagaatcatctgttttaatgcaaactcacctgacacaggataaaattcgtcttaaatggcactgagtaaaaccaacctgaagaaataatcaccaaatgactgaagacacaaaacacctactcgtgagccaaaccatgaagcagaataaaatgtaaatcacgtacttatctcatctcagagaacagctgagcactcaagcttttcttcttctttttgcctaagtgagtggaaatgttttcctttcatttactggaaacaaaagtgatgccacatcagcagataggctacgaaataaaacattaaaaaaaaaaagatgatgcctagttaatggaaacaaggcacacgacaggagactccattagggcatgaattttgcaataaaaaactgtattgggagccgggctcagtggctctcacctgtaatcccagcacttggggaggccgaggcgggcagatcgcctgggatcaggagttcaagaccaacccaaccaacatggtgaaaccccgtctctactaaaaatacaaaaatttgccgggcatgttggcaagtgactgtagtcccagctactagagaagctgaggtaggcggatcgcttgaatctaggaagtggaggtttcagtgagccgagatcgcaccactgcactccagcttgagtgacagagtgagaccctgcctcaaaaaaaaaaaacaattgtattggggaaaatgtacatgtggaaagaaaaggcctatgatcctatcaaggacagaaagagcacacagcacatgccaggacccacggggtccaagatgcaatatagataggacagccaaaaatacaccaagttagcggtggagggagcatgagagaagtcagctcagccaaccagtgaacaggaagaaaaccattaagtggaaaagaattcataaattgtaaataaaatcagaaacatgatcaatgtgaaataaagaattctatttttggaacacaccctccccaaaagacatgttttgacacatcataaatgaaaaatgttagtagagtgaaatgttctctcaattagtcattatgctaagagaaaatttgttattaaaaattccattttggactaattggactttaggaaggtccttatagacaaaagagagaaacagaagctagaagagagcatcactgagtagattattagctaaataaacaatcaaccaggtgcggtggtcccagcactttgggtgcccaaggcaggtggatcgcttgagcccaggagtttgagaccacccatgggcaatatggaaaaaccctgtctctacaaaaaaaaaaaaaaaaaaaaagcaaaacttagccgggtgtggtggcgtatgcctatatagtcccacctactcaggaggctgaggtgagaggatcaattgagcccaggaggtagaggctgcagggagccatgaacacaccactgcactccagcttgggcaacagagggagagctgtctcaaaaaaataaataagtatataaataaaaaatctcctaagagtgcttaacaacagcacaaatctgatacaatttgtcggctagggaggtctcaggtgtctgatcacagccctgtctcaaagtttgtgtctgttcctctcaaacaacatagacaagaacactgatcacatggttattaaagtcgcatgtggcataaagtactcagagataaccaaatgattgattaaatttacaccccaaaagccctaaataacccatagcaatggggcaaatctaacacgatgaaatttaaaaaggaatatatttcaggttcctcacttgcttcaaaaacataaaacccacttgggtcaaaaataactccacttaacgtggtttatataagatatattatgtggcatatgtggcttatcagaagcacaaacagaaattccacagaagttgagagtgtgatgtcccagcctcattcaagagcaaggaaaggggtggtctgttctcctctgcactaggtgggccacaccagcggctgtgtctggctctaggagccacattccagaaagacgatttacaacctagcttctgttaaggacagttaccagcctaggggaccattgggttatgtaaagaactgtaagaacagaagactggggacacgagagaccttctggcattccaagttctagcccatagtaaagtgttagatttgctcagcgtggtccccagagggtgaaattagggccagtgggtggcaaatgctagacagccaggttttagccaggtataggaagacacttccaagctaggtgtggtccctgtaatcccagcactttgggaggccgaggtggaaggatcacgtgagcccaggagttcaaggccagcttaggcaacatagtgaaaccccatctctataaaaacttttttttttaaattaaccagatatggtggtgcgttcctgtagttcccagctactcaggaggctgaggcaggaggatctcttgagcccaggaggtcaaggctgcagtgattgcaccaatgctctccagcctgggcaacagagcaagaccctttctccaaaaaaataaaaaagaaaagagaaaagaggacgacatttctgacaggggtgcctcaaggtaaaacaggctgccgtaagaattgggagcaaattgccagtttctggacacatttctgcagaggctccaaaaccacaaaagaaatattttagatgagggctgatggtcatttggggttaggaacctaaaggttcctctaggtgctgtttgtgtgtgtcatttgctcttcacccaatatgtccactttcagacaatacaaaaagcaaaagagaacgtgtcttggcttttatcttgctgtcaaaatctggtgcggggcataaccagttctaaaaggtagcattaaactttcagagaaggcaagaaaggacaatgggggctaggggacagggagggccactggagaccagacatcacccaccatggccaggggatgggaaggacccaccgagaaggggggttctgcccaaggctgctccctcactcctccacgctgagtctgaggcctttccctgcccacccgctgtctgcctcttgctaacttttttggttctttaagctgctggcctaaatctcacaaatagtgtgtttctgtctttttattttattataaaaacataacagaaaaaaaagggaaaagactagtttaaaaaaaatcaaatcatgaactatttgcccagtgcaagtcatctgaaatgcccttctccatcttcgggaaagcttcgctctgaatgctagtggatttgccctgaactacccaagctctgatttccggagcattatttactactgtacatggtcgcgacagttcagtctatttcagtcccacagcaacactgagtatttctctcttccatacttgctttaaaaagttgcaactcacatgtgaatcaaagctaatcttctatgtaaatgtgcaagccttcaaaactttttattgaaaagtcataaacacagtaaaaaatgcagaaaatattttaaaatatataatgaagaagaagtcttcctctcaggtcccaatccccatccaccttccccaaaggcacaagtgatgaccaatttcttgtattaatctatgcatagattatttctttatttatttttgtttgttttttttgagatggagttttgctctttcacccaggctggagtgcagtggcatgatcttggctcactgcaacctctgccccccgggttcaagcaattctcctccctcagcctcctgagtatctgggattacaggcgcttgccaccacacctggctaatttttgtatttttagtagagatggggtttcaccatgttggccgggctggtcttgaactcctgacctcaggagatccgcccacctcagcctcccaaagtgctaggattacaggcgtgagccaccgcgcccagcctgcacagattatttctaacatgatatgcaagtgcatgtgtatgctcacacacacacatatatgtgtgcatgcatcaacacgtgaacactctttttcacataaatagaagcaactctcacaatgttctgcccttgtttttgcactcaaggtgtgctacacttgtcactataacaccaattaactcacacaccactggcatgcagaggaatgatgtcagagtaacctgcaagttgcgttggttcacaggcaattttttctaggcaaggggagcttagctttgaattacgagtgtagaataagaaccttcagcaagaaaggaaatggctctccatatgaagatctttcagtagtgtcttaagaaaatgtaaaaggagtgcctgcacggccccagagaggggcaccccaccttgccagttcctaccttgtcggtcctgggcttgcaataaggtgtaaatccttcagtgctcatgtgcctgtcatccccaaagcagcatccccacgccattattactattaatagtatcatcatcccctcaagcagtttcagctccactgagctacctgcccggactgcccaagttacctccctgtgtaccaggattgcttctgtcagtgttcaggtttggaagttgcacatgtctcaagaggggtcccaataacgctgccttttctgtagagctggttatgtttaatgtgtgccgggcagagtgcatgtgatagcagagaaggctgtatcttgggaatcccatgtgaactggtgcaggtcactggacagtcttcctcacagctgctccatacactagctgtgtacttcactagtctccaaccaatgcccgtctaggctgcatgcagtgacttactaattaaatgatgctgtaattaacctggaaagacatggttatgaactgaattgtgttcccctccagaattcatatgctgaagtcttaactcccaggacctcagatcgtggctgtatttggagacaaagtctttaaagaggtaactacggggccgggcacagtggctcacgcctgtaatcccagcactttgggaggccaaagcgggtggatcatctgaggtcaggagttccagaccagcctggccaacatggtgaaaccctgtctctactaaaaatacaaaaaacttagccaggcacggtggcaggtacctgtaatcccagctactcgggaggctgaggcacgagaattgcttgaacctgggaggtggaggttatagtgagccgacattgtgccactgcactccagcctgggtgacagactgagactctgtcccacaaaaaataaaaataaaataataaagatataattaatataatatattaaatataataaaataaaaatagcaatatgtaatctaacacttaaatcaaagatcagtgggcatgtgggaaaaaaaaaaaagccatgggataaaatcacaaagattaagtgcctgggatgaggcataggaaagcagaaagggaaaatcccctgcaaggtggcagctttacctgcctcacgatcctgctaactgctagctgtgctttacctggatttagcctaatgcatcacgtcaccccgtcgctcctttaactctcacagtccatgcgagaaacactacaaagccacttcacagcaaaccctaccttaccgtgcactttcatgtaccacccagtgtgggatgcacatgcattttgtgaaattattctgacatttggattcttttaaaaaataattgtgcggcccactttttcatcccacgatattagagaagaaagctaacttgattccttctttccagctttgaattaaacctagtgatcaatgaattattgttttatcaatctttcctggataatgttcacaccataatattaaattagaaaaagacatctaatttccctcacctataaaagttatatgatctttctgctcatgttcaatttgcatcagtccattgagtcacaagtgttccaactccaacacaatcgtgacgtgtcgttattacagaagcagctcattctgaaggaacaaggtgttctgcctaagaggagtcccagataactcaagtttgctattggagcacaggaacttgattgtgttatttaaatgcagctatccttacatttatatcaatgtacatttttctatttaaacatatagcccgcattgtctttgggagataataagttccttgtgtttaataattgccatggcaagtggtatttccattcatcataaaatcacttatttcatagtggagttcttccaggaacatgacactcgatgtaatcagatgaggagacaagccgagacgttctgaggttcagtggcagctctgctcctgctgaactcagggccaaggccccactggccaggggatggagtgagcccctggcttagtcttatgcctcaggacggtggcctgctccctggactcagagaaaagcctgactgttattctcccatctctctcacagccattgccattcctctggcctcaatctcatgaccttaattctatgtgttcaatctttctgttccctaaattctcaacatggaagctgacatctcatctcttcctgccagccactttgctggccagcctacagcctggcctgctttggctcagaggcccaacactgatcccatcagttggggaagggctggaaaggggcaaggtttggtcctcataaggctgctcccttggcaatgaagcagtgtcacttaaaagaggataagacaccactagtgacatattcccaccaggggcttcaagaacagtccctcagttctaattggcatggagtaagcatcactgtgttagctccagctaaaccctctgggatctgacagacgccaactttctcttctgagcatccacacttcctggctggattctgatacagtttaccttcatccatcacctttgccaatattttggctactttgttaggcaataccagagtgaaaaattgccacagcgccctaatgtctggggggatgctaggtttagatggagttacgtgacacacttttattgccaaaggctgctttagtgcctcacagatcttccgcggaggtctgccgaaaggattcaggtggccctgctcagactggaaaactcctcatcgttcagggtaattttaggactccatgcctgcctgtggatggatcccttctacaacatccccaccaagtggctgtccagcctccgctctgcatctccaggcagaaggaactacacccacaggcaacgcattctaacttttaatgactttgttaagacggtactttgtactgagcttaaatttcatatcccttcaacatccacccaatgaccctactttgccccccaaagccaatcagaacaggtttacttccaggggagcaactgagtgtaataaagacctggtgctcctgtgtctggctgtgattctgagcaagttaactacccttgatttaaaaaaaaaaaggaagacagggctatgtccctgcggaggagaagggtatacagtgcatggaaacccctggcacacagtcgtgtccactaccttcctttcatctgcatggcagccctgcagatatgtgaaaatatctgcctccaaacatcctctcgtccagagtaaacattcacagcctctttaattgtgccgcctaggatatgttttcaaggcattgaccatccggaatgtatttctgttgatcagtgtggcttctgttccttttttctatttctagttttttatgtcatccattctaaaccattattagtttatggacaggccataccaaaggcatcccccattgtgaaccaggaaggggaggctcagaggagaccccacccaagaagacccccccatggagggatggtgccaagtctacccccagttgccacccacagggacagtggaacttctggagcctgtttagccaaccagctggactgtcatgctagaggtatggttggcctcttcccggccatcccactggagaatcctttggaagtatggctccctccacttcccatcctaatgagggctaaggagatgttgactagagctgggagaagtgtggatagtgccagtgctcaggactgggcgtggctcttctaagttaccagctcctatacttggtaaccctatctgccaagaatggcagtctgaaagtgaccttggtttccctaattccttttctaatcctgagaaatagtctcctcgcctataaagctccctgtggtatgaggacatggctgaggctatgctgtggcttgcccatacccctaagaacaggaagacctcctggggtgactggtgttcctcaggagccatctgatcacctgggaagtctggtccaaatgcacggccctcttgacttggtagagttcccccagacaccactcctaggaactactctgtgagtggggctccctcccccgggaagtctccatccttcacatgctccagacgcaccttccagtcctctagtcctctctgggtggagacagtggcctctccatgcctgcactgcacactgtcggctccccttgccccaggtcagccttacaatcctccttcctccttcaggatgatgtagggtgcaaataacacaacattcatgtaaaagcagcataaaacatgggcttattacttcacataacaagacgtcttgcagtacgaggctcagggtcaatgcagcagctcagcagcatacccaagacccagggtcgttccgtctgtctgctccaccagcctcggtatcttggcttccatcttcacttttccccgcatggttacagagtggctgctaaagctccaggcattaccgtcctacatagcatgtccaaaaacaggaaggatgcttgctcctcatgtaacaccttctattagcaacaaaagcctttcccaaagctccgagcagacttcccctcaaatctcattggcaggaaccaggtcacatgcccacagcccaccctaacacccatggcaaaggggaatggaattgggtaattgatagggcctctcttcactgagcacattgatcctgacacctgagaaacggagggctctgctggcaagacaaagaggcgggggtaggaggcaggcagtgtctgcacactgccttcccagccccctagtgtccctgctccaggacaggcgagctgggtcagaggcctacagatgttactgcacagccaggtgagaacagctccatggtccagatgacttcaggcatcttaatgaaaggctggtcacactaaggcacatagggccccaagggtacttcttgttcttctgtttgttgacttaagcagactcctgaagtatgcactgcaatgactacagtttttcccagaatgtgctcagccagtgataagctatgaaataaatgcaacagcacaagctcagaagactcctggacttcagaacacttatttcttcacagccaggtctttaacacctttggccaccagagaaagtactttgggaggggaatggaatccagctgcatggcttaaatgtcaaaaatcttgcatttcttctattctgttgagctgtaatgtatgttgtgcataccatctcccagcaatgatgaacacagtgtatctggaagaaagtctcatttcttaactcttttgaacttgctctctcctgcacttaatggagctaagcatctgagggagtctgaacaccagaactaaccgagggtctgaggagccacctgagacacctggggaacacagggttgcattcctgggggtcatgcttttggaggaagatgcattcagatgggagattgcttaagtcatcagcccaagtgttcatggaaacccccatgtctgtttatcacaggtcctgttaggctacatcacccctaaactatacttcttttgttttcaatcttatcgagttagcattggcccctgatttcaatctgtacctgcatttataaatcctatttttgacagccaacacagtagctctcattccctgattcatgtcacgtacaaatttgatcgatgtccttaacctaataactgataaaaatttaaatcagagaagccacactaacctctgcaggaaaatccttactgtacagtttacttaacaagccacaatttcaaaaagcaattaaagatcctgcagactccaaatcacaacacttctatgaaacagcccgtttgaggttgagagacaagcatcatctaattcttgtgaaactaaatgctaagttattaataacttaattaaaaacaaaaatgctaagttattaataactctgcacatagcttgatgcctgtattagtctgttgccacgctgctgataaagatatacctgagactggccaatttacaaaataaaggggtttaactggacttacagttccacatggctggggaagcctcacaatcatagcggaaggcaaggaggggcaagtcacatcttacgtgcatggcggcaggcagaaagagcttgtgcaggaaactcccccataaaataaccatcagatctcgtgagacttactatcataagaacagcatgggaaagacctgcccccataattcaattacctcccactgggtccctcccacaacacatgggaattcaagatgagatttgggtggggacacagccaaaccatagcattccatccctggcccctcccaaatctcatgtcctcacatttcaaaaccaatcataccttcccaacagtcctccacagtcttatctcatttcagcattaactcaaaagtccacagtccaaagtctcatccaagacaaggcaatcccttccacctatgagcctgtaaaatcaaaagcaagttagttactttctagataaaatgggggtacaggcattggataaatacagccattccaaatgggagatatgggccaaaacaaaggggctacaggccccatgcaagtccaaaatccagcacagcggcaaatcttaaagctccaaaatgatctcctttgactccatgtctcacatcctggtcacactgatgcaaaaggtgggttcccatggtcttgggcagctccaccccggtggctttgcagggtatagcctccctcctggctgctttcattggctggtgttgagtgtctgtggcttttccaggtgcacagggcaagctgtcagtggatctaccattctggggtaggccctcttctcacagctccactaggtggtgccccagtaaggactctgtgtgggggctctaaccccacatttcccttccgcactgccctagcaggcctcactgcccatgagggccccgtccctgaagcaaacttttgcctgggcatccaggcatttccatacatcttctgaaatctaggcggaggttcccaaacctcaattcttgacttctgtgcacccagaggctcaacaccacacggaagctgccaaaacttggggcttccaccctctgaagcaatagcccgagctgtaccttggcccgttttagtcatgactggaatggctgggacacagggcaccaagcccctagactgcacacagcacagtgaccctggggatggaccacaaaaacattttctcacaggcctccaggcttgtgatgggaggggctgccatgaagactctgacatgccctggagacattttccccatcgtcttggggattgacattcagctccttgttacttatgcaaatttctgcattcagcttcaatttcccctcagaaaatatgtttttcttttctattacattgtcaggctgcgaactttccaaacttttatgctctgcttcccttataaaactgaatgcctttaacagcacccaagtcacctcttgaatgctttgctgcttagaaatttcttctgccagataccctcaatcatctctctcaagttcaaagtcccacaaatctctagggcagaggcaaaatgtcaccagtctctttgctaaaacataacaagagtcacctttgctccagttcccaacaagttcctcatctccatctgagaccacctcagcctggaccttattgtccatatcgctatcaggcttttggtcaaagccattcaacaagtctcaaggaagttccaaactttcccacattttcctgtcttcttctgagcccttcaaactgttccaacctctgcctgttatccagttccaaagttgcttccacattttcgggcatcttttcagcaacataccaatttactgtattagtctgttttcacgctgctgataaagacatacctgaggctgggcgatttacaaaagaaagagctttaattggacttacagttccatgtggctggaatatcttacgtgaatggtagtaggcaaaaagagcttgtgcaggaaaactcccccctaaaataaccatcagatctcattaaacttactcactatcatgagaacagcacaggaaagacctgcccccataattcaatcacctcccaccaggtccttcccacaacacgtgggaattcaagatgagatttgggtagggacacagccaaaccatatcaatgcctctataaacccaccaggaacacttctagaaaatgttgaacacctccgaggccccacagaaccctcctctacccacatcttcatggcaaggagctaccatggatccccctccgagtgtgcccagaccagttacaggactggttacagtggaaggcaactgagaggcatagagcaagagctgccctcccactaaagtcacacaccacagaaagaactcattcttcataagaagactggagctactgaaaaagggacagacactagctgccaaaaacctggctgaagtccacaacatcacatcccctcatctcagactcacacaggtgctctctacaccatcacactgtttacttcagagaactccacacacactaagattcccttgcttatttgtttgtctctcctttccagaataggaattccatgaggccaggggctttgcatgtctatttaccgcagaatctcagagcttcttctacagtagatactgaatacatatttgttgaatgaatgaatgtgtccccagatgtttctcatttaaatgaaaatgatcaaactgaccaatttttataagtttagttaaagatgtgaccatcttacttcattacatctccattaagacagtttggtatttcagttacaggtgtatgactgggagttcaattcttttctgtgataagtacgaatgactcaagctaccattcaatattcactttacagatatatgaagcttgtctactcacgttcaaaggttttccttaattcgtcttttatctaaatcagtcaagtctcttctcataaatgagaaatattaaatgagtggcagctctcaagaaataaaaaagtgactagcagaaataatctgcaacttctgtgaataagatttttctcagtgtctaaaataacaaacaccatttatggaccaaagactaggtgccatgagttttagaaattggtccccactccactgttatgtgtaccattatcccagtggcagagatacacagaaagccaaggctcagaggcagtaagtcatgggtccgaggcctcttgctgatgacaaaactggaatctgaacccacgtcaggcttacatttacacatacatgtatacaaatgtacacatatacagcttagattccataaaatacagtaatctagtggtggaacaaattatttctaataaatgttataaaatataaacgcctctctgaatcctttagaaaattaattttgccatgaagtacaaaaaggaaagagatacaacttaagtatgaacaaagttataggatactacaaacagttggtaatatatactgtctttaaaaatcatttctccttatcgaggcattaagccatattgtttataatgtgaagagctattggcatcttattttcctacccataaccatgaccatcacttattcatcttttcatgcatccaggtgcatggaaaggcagtaagtacaatttttaagaaaatagcatcaaaagcagattttaaatctacctgtttttcttcgtttgttttctccaacagttaaggaaagtaatagtaatttctcattccaaaccaaagacaattatgctcctttgctaaggacacagctgtaagtctctacaagatcagggaagactacaatatttcagaaaaacactcccagtcaagtttatgcttgaatgggcagctggaaatgcatcgatgtacagggcctcttttcacggcctctaaaagtgcttgcatcatatgcccacactgtgtctatcccctcccccgtgacgtggtctggagtccaatgtgggaaagggaaccggcaagcaataactcgtgcatcatcctcaagttcacgttcaagtttcttctccaactgcagcatctgtggagagtaacagctattattttagtgagcagtgagtcagaggaaatgatcccaaaatttcctgtttttaagagtccctgaaaatacctgagcaaaaattactacttgttaaaaagagcactctgggacacaaacacataaacaaacaatccattgaaatacagaagatacactgacagcagttgtaagaacaccttctagtattaattataaaatatgccatttttagcagatgtctatcatagatttatagttttctaaataaaatcaggatgtggcagtaattttaataagaagcagttttaaataacgcacttcaacacttcaatatacctagtctcatatatttaagacattatttttccaccattttttaagagagaggggtcttgttatgttgcccaggctggtctcaaactcctgggctcaagcaatctgcccacctcggcctcccaaagtgctgggatgacaggcgtgagccactgcgcccagccacatttttgcacatttttaacatctctgaaatcaggacacatcacacaacactaattgtcttagaattataattagcaatttttttgtttctcaatagcaatggtgcatcctaaaatcaagatctacagtcaatgaaatgtggtatagttagactatgaaaaaatatgcacaattctaccaactggaaatatcatgaaatatttcataatttttaaaaatgtatccataatatactgataatgaatttcttgatagcctaacttataccaccgttgtaccattttattatcaatctaccaataaagagtttttattatttgctagaagtattgatattttaattacatcagcaaattaacaactacttaaaaacttatctgcagatcctaaaaatatattaccaccttcaccaccttcacatcctaaaaataatttttttctactttcttcttttaacttgctattttgggataatttcaaacttccagaaaagttgcaataacagaacaaagaactcctgtatacctatacccaggttcaaataatttttttttttttgagacaagatttatcgcccaggctggactgcattggtgtgatcttggctcaatgcaacctccgcctcctagactcaaatcatcctcccacctcaacctcctaattttgtagagatggggttttaccatgttgcccgggctggtcctgaactcatgagctcaagccatctgcccacctcagcctctcaaagtgttgggactacaggcgtgagccactgcagctggcctacaggtttaccgattttcaacattttgtcacatttgttctcttcctctctttgaacatttttttcctaaaccattgcagaaaaggttgcatacaatatgctcctttacttccttaatacttcagtgtgtattttctaagaaaaatattttcatacataatcccagcacagttatattcaggaaatttaacattgtattccaatataataattccaaataacactgcgattctgtcattgccccaataatgttctgtataacatttcccaagggtatgatccagtccaggaccatttttgcatttagccataacattcctttggtctccttagacggaaaacagttgctcagtctttctttggttttcgtgacaataacattcttcagttatcggaccgagtggccctggcggtgggtcctctgatgtgtgctcatgagcagtgcggtgtgtggtctttggcaacaccccacctgtgaagctgtgaacttaccagggctccacagacacccaggaggcccttctgctcttgatgatggcagtaaccacacagtgaaggtgggatccggtgtctccattgtgcagttgctatttttgcttttataatgagtagtttgtggggagatgctttgggatgatgtaaatcctgttactcatcagagagtccctacacttgaaatagcactcacggatgattctggcctgaatcaatctgctaattctgtcctttcttctagatgtacagttggcactctaccgtaaggaacagctttcccctcacctgctctgcctctctctgtctccttatctaccgatctgctataaggacaaacacctatattcttatttcatttgatgggttataatccattactgtccttgtgtattcgaatgctcgaattctcctaatttggccactgggaggctcttgccgctggcttctctgtcctttggacatgctgttatcaaatactgtgagcactccttacattcaggcttaacaaaatgttcctggcttttgtatcttcccttccacagtcctgattcagcctttttctcaaagattcctggttcctcttagtgagaagtgatatttagaaaacaagatctaagcaaaaattattcctctaaaaagtaaccaagatgaaattgatagggcttctatgatggttttattcctggcctatatcttataaccaagtgctcagaaaaacttctacatgacctacagctggaatgaactaaattctaattcttcattagaatcaatgcgaagataacacagaataaattctattaaggatggaggaatttctattcttttaacagccagtatagattaaaaaaaaaaagttttgttccttgagggaaaaattaaataagcaaagaatgaaacaatatgtgtttttccaaaatatcagagatttcttatggtaattttgttcataaaaaggataattataaacttattcatgatgctattattcttttctcttttatagtttcttttatttccaaatgattgtcatatgctaagtcaagataaacctaaaaatgaaaggagctatttccatcataagaaattaactgactaaattacacataaatatgcaatgaatctggtgcttgatatcatacgcaaagagaagccgtgatgtgtcatgtctgcgtaaaggaattcaaaattattcatacaattataggtttcaaagtggcatgaactcatcctattctaattacatctacaaaactttaaacatagttctgaaaggtataagataacccagccctgccacacacacacatcccgccccccaggaaccccggtttcactgggccgccagtgtaactcactcctggcacttcctcctccccaggctcccctctcaagtcctactggttgcccctaatttcctagacctctaatgccagggtccagagctcatgccttcaacagctcatcctcgtgctccccatggagtctcagctactcccaggctccatctgtgcggatgcccaacaaacctacatctccagcccaccctctggcccgaaccccagactccttctcacccaccactgccagcctgatgtcatgtacacccaaacttcacatgcccatgctgactttcccagccagctccgcctgcaccttccccagcatagttcaaagcaactccaagcgtgtggcaggatggcccggtggtctaaggtgctagacacaagcttccacttcccaaggcaactccaaacttccagtaacttgggccaacacgctggggctgcctgtgaccccacctttgtctctctccccaacgttagatctgccagctagtcctgtggattttatcttcacaatgcacacagaatttgatgcttctcaccagctactccgtggcctggacacctgcaagagcttataacctgtctcccagcttgtacccacccctgcctccacatggcagcctgtgacccttctcaagcccagccagccctgcattcctctctgctcacccaaggctcctgcccttccaagggctggtgtccttcccatcctgcttcctctctgacctccccacgcacactcatgccacacctgcctgcttgctgcactgccccccaccctgcccgaggcgctcttccctgcacgccccctccctaacctcagaggtcacctttgcagggatcctgtccctgccccaccccgcccttgctttgctttgctccacagcacttttgcttctgctgtatgatgcatcttctacaggcatctcatgtaatatctgctctccccactagcatatgagcacctggggcaggtgtgttttctcttgtactcactgaagtattccaagcgattagaacagggcttgctatagtggccacacttgtcaaatgaatgaaggaaagaaggaagaaaaagtgattcagctacgagttatttttcttcactagaacataatgataatatttttgttcatcagttcataaaagccaagcatggtggctcacacctgtaatcccaacactttgggagtctgcagccggaggactgcttgagcccaggagtttgagaccagcctgggcaacatagtgagactctgtccctgcgaaaactaaaaccatcagccggacatggtggcacacgcctgtattcccagcgacttggcaggctgagacaggtgatcgcttgaacccaggaggctggggctgcagtgagccaagatcacgctctactgcactgcagtctgggcaacagagtgagactctgtctcaaaaaaaagaaaaaaaaaattcataacagaatttgtaactaaaattggtcattctttgaagttatgaaagtagatagctttctgggaaaagtataaataatgggtatatttagaccacattcattcattcaacaaccgtttactgagtgatgcctgtgccagtgctgcggtgctggaggcctgggccagctagaagaagaaaggcctggtccctgcccctgagctgatggtgcagtgcacacagctagcagtgtcgaagccttcagacaaagaaatgcacaataacccatctaaggacagggcaacaaggtactatatgagagtaaagcgggccgctggagctcgcctcattgtcatcaaggactgccttgcagaggaaaagacagctggcccatgagtggtcagtgctgttcgacgaagtccagagccagggagaccacagtcagaaggaaggaaacaccccaggctctgggaagagcagcaatggcgaggtccagggggccgagagaaggacggagggctggtgcagagagctgagggcagcatggcccaggggaggctggaggggagcaggggcccctgcgcaccagcctcagggccacagtgagtatttgggccttatccctaaaaacggcaagaagtcacagaagggttttacacaagagcaaggctgatctgctctgcactttgaaaagatgctctcagtgcgtaagctcatgttaaacatggatgttcacaaccccacaactggcttgaccagatccagatgggattcctgctcctttttagatagatacatacttgtgtggaaatgctagggcacctctgattttgagctacaaccgcacagagctgttagggatcatcagtctggtatcagaagcaggggtgagggtttacagccccagagattcctggctctgggcctccccaaggctcccctggctctctgagtatctacctgggcatcagcagggaacgtcacatggcatgctggctttgtggagtcacccagccacggctgggatggtcgactggcacagcacacgccccctcccctcatggcctccactgagacacagcttgatgaaggctgaaagtaggggcctccacacacaaaacttagccttccaaaccaacagaagccatcccagcctccgcacccctgaccgacccaccagcatgaagacagcaagctggccaaatctctattacagggaacgtggacactttgtatccttcagctgctcccctttctccttgggaatagtgaaatggtacatgttccttatttcagatttctctacatacagaagaatggacagtaatcacaaaagtattcataaataataagactcttatttcccctgattgaacagctccataaagtgagtcagtctacttcaaacatggtaagaagcacccggagtcggctccacaggtcctggagtgacgatgactaccaaaggccactgctgccccccgctgggacaagtaatcctgatttcatcatcctgcctctccacaacgcatggaatttccagtaaatgctaacattctatttttataaagcacagattcaaattaaagttacttgtctccaaaaagctaacaattccattttagaacgaaagcccaaacatcacaggtaataaatcaccatcaaaattgcgtatcaatctatgatcccaatcagttttttaaaaatgaccagggagtgtgcccttctacctcatttcacttctataagaaaaggctgaataccaaagtttggtcttaattttaggcctaatgagaattataaatgtacaggatactgtcactttcaagaacattttacaagactgggcacagtggctcacacctgtaatcctagcactttgggaggccgaagcaggcaaatcactggaggtcaggaattcaagaccagcctggccaacatggcaaaaccccacctctactaaaaatataaaaattagctgggcgtggtggcaggtgcctgtagtcccagctactcaggaggctgatgcaggagaattgcttgaaccagggaggtagaagttgcagtgagccgagatcatgccactgcactccagcctgggcaacagaacaagaccctggctcaaaaaaaaaagaatattttacaaaagcatttctaaattatattttaaaagtaaagaatatggcattatactgaaggtcttagtagtagaaatacatttctcaagcactgaaatgtcttatacaaaaatttgggtattaattaaaaaacaaaataaaaaaaggtaaattgtctttttaaaaaattaaaaccctatcagctatatcacagcattttagcaaacattcaattctgccaattttattatggctacaatgatagactttgaaacgtgaaaagggatttctttccatggtctgtgcaccagcaatacagcaaaagcttcccaccatgaccatccttccaaaggctaaggagggccattttcagtacaatactgtggcattttcacttttgaaagtacataatcaaagttcaatatgccatcctctagcaaatcagtaaactgaggtaaactgaaactactcaatgctcatccacccagaaaattatcttccttccaaatgggaggaatgatcaattcagagggaacatctcattaactttccggagcgatttcagcgaagtggaagtgagcggctgtgaaaactgcaaactacattagacacgggacctcagaaagcagtttccaaactggaatgtttaaggcttagggaaatcattgagaatttaatctgaagccaaagtttaaaagtatgactgaatcttttatgattaaacttctaagactctgaagtattttattaaatcaatgaactgaaatccagtgttccctaaaatctctgggaggccatcaccctcacacgggtgagtggtggtgttgtggctggaagggccttcaacatcatctaaccccaaacagagagcaggaaagtgcatactcaccatctgaggcacaccgaaaataacaacgttcgagtactgcgaaaaagtaacctgaacaaggtgggaaaataatcagtagattaagtgcaaaaagccaaacgtgaagcttaacttgttttacagaaatgggtagcagttttccattttaccaaacggtgggttttgatgaactcctaagaacagcggccctccttaagatttcacaaggaaaagaataacatgttcatgctctcattcattttaattcaatccactgcagttttccaaacgcttccctgtaagtcatcccatctcatcctcagggtgactccatccagggcacgccccagtggtcatgcgtcagacagctagtgaccacactgtgaccccactgtgaccagctggtggcaccggggccacgtgttcccgcaccagtccactctataccaccagcttcaccagaacacaggagacttcagaaccatctgttttttgttgttgttgaaccatccttaaaatttgagtccccctcctcttctctaaaatactatgtaaaaaagtgcaataaaatggtctttagttgaaaaactggggggaaatgtgctttgccagttaaaattcttattgcccaataagtcttatttactctatagagagatcgtttatgcacatatggcataaaaaaacaatgcaagcaaaactcaagtgaatttttgtaagctactgatgacaatattacaatggaaaattcttatttaagaaaaagcattttatggaacattcctaaagcaaaattacagggcatttttagagtttttagagtacaaataaatttggaagtatcttatactttatgaggataagaaataaccgtgatagcacgattctccagcaaccatctctgtgtctctctaaatatacgaatatgcatacacacactcacacaggcacacaaatggaaaagtctaatatttatcaataataatttataggatttccaaatgagatgaaaaatctcattattttgtaagaaacagaaatgacaacattttaatttagtaaataaattcttggaattcacaagacctatcatataaaaactttaagcttctctctaaaggagactatttgtaaaacgtatcaattttacatatttcattatgccagaatattcacttggattttaattatttttcttttaatacatttttcagttctcagtcatactaattttgaataataaaattttcccttggatttctctagggccattctctgccttacataccttccacaaatctgaaatataaaatttggcagatccatgcacaccttctcgccaagcgcggtatctggaataccaaactagccatgggtttaattcataaccaactgctgtgaaccctttcttcgcagccgctatgacctgtggagagaggcaggatttattcaaaataagaagaaaaaatgaacatacatggtcaaacaatatgaatatttcctatcaatggtttaaacatccaatcaaaaagcacctcccgtgactaagacatcattttaaaatgtgtctctaaagcgatatagctttgtggacaacgtaatagtcaacccatgcaacttagtttccttgattggttaaagacttcacctcaagtatcagaatagacattcaggttcacttggaacacctccataattgattctaggtcagccaacccccggggaggtcgaacaaaacattgctgaaaatccactgcatctctccatcagtgggctagcacagcagcagtgaaatgaaagtgtctgggaggatggttttgtgaacaagtaataatatgcaataaaaataacctgtcaatgaaaaatctgcaattagttacatatttcctttgtagttaatgactgtttactcaaaactgaaaacaggtaaaagtaaaatgaaatgaatcccaataacgtcaactgtggaatcccactggcctccggagagtgggagggatgtggggcagtcctgggttctctctgcctgttctgtcctgccccattctttaagggagcatcccttgactcagctgtcccacctaagatagttcccaagtactacagtgctgcaagaaaacattttctcagaaaccacagatactcttcaaatacgtaaagcattcaaatatgaatttcaaaactttctccttgatttattgatatggtttggctctgtgtccccacccatatctcatcttgaattcccatgtgttgtgggagggacctggcgggaggtaactgaataatgggggcaggtctttcccatgctattctcatgacagtgagtaagtctcacaagatctgatggttttataagggggagtttccctgcgcaagctctctccttgcctgccaccatcaatgtaagacatgacttgctcctccttgtctttcaccttccaccatgattgtgaggcctccccagctgtgtaaaaccgtaagtctaatcacctctttcttttgtaaactgcccagtctcaggtatgtctttatcagcagcatgaaaacagactaatatatttcttttttttttgagatggagtctcgctctgtcacccaggctggagtgcagtggcgtgatcttggctcacttcagcctccgcctcccaggttcaagcgattctcctgcctcagcctcctgagtagctgggattacacgcgtgcaccatcatgcctggctaatttttgtatttttagtagagaaagggtttcaccatgttggttaggctggtcttgaactcctgacctcgtgatctgcccacctcagcctcccaaagtgctgggattacaggcatgagccaccacacctggccactaataaatttcttagaaacaaatagtggctcccagagggtgaggggaggagaggagtagaaagttattatttaatcggggcagagtttcagttttgcaagatgaaaagagttctggagatgggtggtggtgatggtggcacggcaacgtgaatatgcttcacaccccgaaccgtacacctgcacatggttaagatggtaaacactacggtatgtgtatcttaacacaattttataagtaaaaaaaaaaaattaaattaaaaatatcttaactttctaacctcctcgtgattattctagctcagaatcacaaaatcagtctctatgtctgtaggagccggtgaaaggtgatagagtcctgctggccttcacactaaatgcttccatagcaccagcctttcccactgctgctggaacttttcagcttatctctgggatgaggctaaggatggtgccaccctgcccacagaggaacctgctctgagacacccacttgcccatcagtggccttttatttataggtgcccaactgcggtcaagtgagagaagttcataaaaagactgatcttcggcttagtgagggttaatcactggctctttcttaactctgtattaccccaggaattattacttatacatggataaatacagacaaatgcagaagcaaacaactatggggcaaaaatgtaaaggagtgaaatgccatgatttaacatatttcttctcatgccacctctgttggcccatgtattttaagagacaatttgataattaccagttaactgttctttttcacctggcatgtttacagcacacttcctcctttaagaacaaattaaatctgggaaaaatgaattccaaacacactggtagttgaatagtttggtcaaacaaacataaaatgaaatgagcactctttcaagctgtcagatttagttaagtctttgtgtaagccttactaaatgtaaagcagaaattttaagttctggtttcaaaccttaaaatgttttagcagaactcacaatgcgtccgtccccactaccgatgtccacaagggatcctcttcggcatcgcaacattttcacaacattttcaatctgcttcgtagttgcaggtacaaacggcaaacagacttttcgaagggctggcgttacaaacggcgtggctacagcgtacacagccaccagggtgccacccacaagcccagtaagtaagaacccccagttgcttttctgcaaactgttgacttcaaaacttgcaggtagaacatgtcttgactgactttcttctttaagtgtttctaggggtatacctagattgaaagcaagcagaagagacacatgtagcaccaaatctgaaatccaagagagcatttttttctacaattctcattggcaaacaaactcatgctttttaaaggataatttagctgaatacaagctaaatgtcaactgtaggatcccacaattagttctaaatcctattaaggtattttgaagaacattattcaatactatgagaagactaaaatcttttctttccaaagtactgattttttgtgtgtctaggagtcatccttacaaaacaatgtattcaaacttatcgagtaatttattaatttaatatccattagtgcaagttttaatcatgcactacatatttttatgttctgaactaacaaagcctcataaacaaataagcataaagatgtctaattattacccaatttcaagtagaattaaaggattccacatcaaatctggtctggcatctacaatccagtttcaccaatacaattttaaagtaatagaagagacaaaaatcaggttttaccaaatatcttaaataagtatggtaataaagagacttttacagcggatccaaaaagaacaaaaaataaggccgggcgtggtggttcacgcctgtaatcccagcactttgggaggccaaggcgggccgatcacgaggtcaggacatcgagaccatcctggctaacatggtgaaaccccatctctactaaaaatacaaaaaaaaaaaaaattagccgggcgtggtggcgggcgcctgtagtcccagctactcaggaggctgaggcaggagaatggcatgaacccgggaggtggagctgacagtgagccgagatcgcaccactgcactccagccggggtgacagagcgagactctgtctcaaaaaaaaaaaaaagaataaaaaataagatcatcattttagtactatcataaacataaaataacgcagaccccaatcactgattacaaagaaatgaatggtaccttaaatatccttttgagatttgtcctttaaaatgcatttaaatgggatctcaagattttgaaattaatattgacaaaattgattttaaaattgattaacaaggagcacagtacaggaggtaaaagcaggactcctccagagccagccaaagttaggatcccagctctgccacctcactaatgatgggaccctgaatccctggtccttgctgagcctgttttctcatctgcaaagtgggggtcacagggatattgtgaggatgaaatgagtgtatggaggtaaagcacttagaacagggtcgaatgcagttataggtttcctataactgctgtaagaaattgtcacaaaattagtggcttaaaataacaccatttatggccaggcgcagtggctcacacctgtaatcccagcactttgggaggccacggcgggcagatcaccagaggttgagagtttgagaccagcctgaccaacatggagaaaccccatctctactaaaaacacaaaattagccgggcgtggtggtgcatgcttgtagtccccagctactagggaggctgaggcaggagaatcgcttgaacccgggaggcagagcttgcagtgagccgagatcacaccattgcattccagcctgggcaacaagagtgaaactccatgtcaaaaaaaaaaaaaaagaaaagaaaatcaccatttattatcatacagttctggaggtcagtctgaaatgaattggcaggcctgcgttccttctgggggccctcgggcaggttttcttgtctcttcctgcttccagaggctgcccacattcctaggctcttgaccccacatcactccaatctctgcttctgtcctgacatcaccttctctcacatgcctggctccctcttaatttataggaaccctcatgataacactgggcccacataaataatccaaaataatctcccatctcaagaccactgattacatctgtacaggtgcaggaattagaatgtggacattcctggagaggacatttttcttcccaccacacccatgaactacggcaatctattctagtgcagtacaaatttgaacccaagacacacagaaagctggcacacagcagtgggtcaccctcagggcagccagccaatcgccagcatcccccactcagcgcagctttgttcttgattcctgaagccccttaaaatgagttgtaaaactgatttcacagtggaaaacgaactgggtcggcggagggggcggtgggaggaagaatgctactaatgctagtgctagtattaatgctagtgatgggggtaaagaaaattaactttaagaaggtgatggcatttgatagaaagcaaaagctttaaataatttcagttataattttggcattttacggaggaacttacaggcataccttggaaatatttagttccagaccactgcaataaagtgagtattgcaataaagcaagttacacaaatatttttggtttcccactgtatataaaagttatgtttacactatactggagtctattaagtgtgcaattgcactgttcaaaaaacaatgtatgtaccttaattttaaaatcctttattgcttgacattttggtctgatttatcttcgaaaaattttttttaatttttaaaaaagagtttattgctaagaaatgctaatgatcatctgagccttcagtgagtcataatcttttcactggtgtaggatctggccttgacgttaatggttgctcaatgatgagggtggtggttgccgaaggttggggtcgttgcggcaatttttgaaaataagacaacaatgaagtttgctgtattgatagactcttcccttcatgaaagattgctctgcggcatgtgatgctgtttgatagcattttacccacagtggaacttcttccaaatttggagtcaattttctcaaactctgccactactttatcaactaagtttataaaatattctaagttctttgtcatcatttcaacaatgtttacagcatcctcaccagtagtagattccatctcaagaaacaacctcccttgctcatccataaaaagcaactcctcatccactgatattttatcatggggttgcagcaactcagtctcatcttcaggctccacttctaactctcttgctatttccaccacatctgcagttacttcctccacttaggtctcaaagtcatccatgaggattgaaatcaacttcttccaaactcctattaatgttgatactctgacctcctaccatgaatcatgaatgttattaatggcatctagaatggtgaatcctttcctgaaggttttgaattgactttgcccagatccatcagtgtaatcactatctattgcatctctagccttacgaaatgtatttcttaaataacaagacttaaaagtcaaaattacccccttgatccttgggctacaaaatgaatgctgtgttgacaggcatgaaaacaacattcatgtccttgtacaccgccaccagagcaattgagtagtaactaggtgcattatcaatgagcagtaatattttgaaaggaatcctttttctgatcagtaggtttcaacagtgggcttaaaatattcaaaaatcatgctgtaaagaaaggtgctgtcatccaggctgtgttgttccatttatacagcaaggcagagtagatttagcatcattcctaaggactctgtgattttcagaatggccagtaagcattggcttcaacttaaagtcaccagctgcactgacccctaacaagagagtcagcttattctttgaagctttgaaaccaggcattgatttctctctagcttccaatagaaggttgtttcatccatattgaaaatctgctggccaggcacagtggctcgcgcctgtaatctcaacactttgggaggctgaggtgggcggatcacaaggtcaggagttcaagaccagtctgaccaacatggtgaagcccagtctctactaaaaatacaaaaattagccaggcgtggtggcacgcccctgtaatcccagctactcgggaggctgaggcaggagaatcatttgaacccgggaggcagaggttgcagtgatcaggccactgcactctagcctggatgacagagcgagactccgtctcaaaagaaaaaaaaaaaagaaaatctgtttagtgcagcaaccctcatcaacaatcttagctagatcttctagataacttgctgcggcttctccatcagcacttgctgcttcaccttgcattttcatgctctggaaatggcttatctttccttaaacctaatgaacctaccactgctagcttcaaacttttcttctgcactctcctcacttctctcagccttcagagaactgaaaagagttagggccttgctctagattaggctttggcttaaagatatgatgtggctggtttgattttctatccagaccactcaaacttgctccataccagcaataaagctttttcactttcttatcatttgtgtgttcactggagtagcacttttaatctccttcaacaactttctctttgcattcacaacctggctaactgtttgatgccagaggcttaattttcagtctatttcagttttccacatgccttcttcactaagcttaataatttctagcttttcatttaaaatggtagaagtgtgactcattcacttgaacacctggagcccattgtagggttattaatcagcctaatttcaatgttgttgtgtctcaggaaataggagggcccaaggagatggagagagatagaggaatggccagtgcagcagtaggaaaacacacatttatcgattaagttcactcttatttgggcatggcttgtggagccccaaaacatttacaatagaaacatcaaaaatccctgatcatagatcaccataacagacataaaaatagtggaaaatttgaaatattgcaagaattaccaaaatgtgacacagagataaaaagtgagcatgatgctgttgaaaaaatggtgcgaacagacttgctccacgtagggctgccataaaccttctgtttgtaagaagcacactactgaatggggcatgttggttcatacctgtaatctcagctactcaggaggctgaggccagaagatcgcttgagcccgggaatttgagaccagcctgcgcaataatagcaaaatcctatctctaacaacaacaacaaaaaagtgcactatctgcaaagtgcaataaaacaaagtatgcctctgtttgctcaagtggtagtcatgcatttatttaagaaaagtcggccaggcacagtggttcatgcctataatcccagcactttggaaggccgaggcaggaggattgcttgaagccaggagttcaagagcagcctgggcaacatagcaagaccccatctctacaaaaaataaattagccatgtgtggtggcatgcacttgtagtcccagctttttgggaggctgaagcaggaggatcgcttaggcccaggaggctgaggctgcagtgagccgtgatcgcaccattacattccagcctggacaactgagcaataccctggttgtcaaaaaaaaaaaaaaagaaaagtcaaggcacatttgtacatgtgtcatgccctctgtaaaaaattatcttgtggacattccagttgtacagtacagcagttaagaggatttgggttacacagttctggagtctcagaacttaattagttgtttaacacaaggtaagttgttactaaggcatggttttctcctcagtaaaatttggaaataatttgtttaaacacaattcaagctgggcatggtggctcacgcctgtaattccagcactttgggaggctaaggcgggcagatcatgaggtcaggagattgagactatcctggctaacacagtgaaaccctgtctctactaaaaatcaaaaaaattagccgggcatggtggtgggcgcctgtagtcccagctacttgaaaggctgaagcaggagaatggcgtgaacctggaaggcggagtttgcagtgatccgagaccgcgccactgcactccagcctgggtgacaaagtgagactccgtctcaaaaaataataataaaataaaataaataaacacaattcaaaattggccagccacagtggctcatgcatgtaatcccagcactttgggaggctgaggcgggtggatcacctgagctcaggagtttaagaccagcctgggcaacatgtcaatacctcatctctaccaaaaatgcaaaaaattagccaggcctggtggtgtgcatctgtggtccctgctacttgggaggctgaggtgggaggattgcttaagcctggcaagtggaggttgcagtgagccgagatcacaccactgtactccaacctgggtgacagagtgagacctcattacaaaaaaaaaaaaaaagattttgcaataatactatcctcataggattcttggaacaggtaaataatgtaaacaaagcatttagcacaagcctgagaggctaagtaatgactattaattgctattattattctcaatactatcatatgcaaggaggggctcaatttttaacagctttgagatataattcatatacatacaatttgcctgcttaaagtatataatttaatgtttctttttatattcagatacatgcaaccatcactacagtcaatttttgaacatttttattacctcaagaggaaaccccttatcctttagctatcacccccgcatccaccctctatcccccagccctaagcaaccactaatctactttttgtctcaagaatcccctattctggggcctggcacagtggctcacgcctgcaatcccagcactttgggaggccgaggtgggcggatcacttgaggtcaggagttccagaccagcctggccaatattgtgaaacaacaactctactaaaataccaaaaaaaaattagccaggcatggtggtgcacacctgtaatcccagctacttgggaggctgggggcaagagaatcacctgaaccggggaggcagaggttacagtgagccaaggagccaaaattgcaccactgcactccagcctgggagacagaacaagaccctgtctctcaaaaaaaagaaagaaaaaaaaaaaaaaagaatcccctattctggacttaaaggaatggaattgtatagtgtgtggacttctgtaactgacattttttacttagcatgtcttcaagattcatccaggttgcaacttgtatcagttctttatttctttttatggcttaataatattccattgtatgcatatgccatatttttgcttacgcatttgttcaccaagtttattaaacaaacacaagtcagatgacccaaatttcatttttcacctgtgtagatatgtacctttcaattcaaccagcaaaagatgtaataaaaagttcctgttcttcacggcctcccatctaggcagatgaggggtggggtccaggagaggcagacacagggctggttgtgagaaatgctataacacaaacaaaacgctacaggcatatgggagaggcggaggaaagactgattccaacaatgggaccagtgaggtgttggcagagagaatatttgagctggagccaaaagcagcaagccttggaaccaaggtgtggaaggcagggaaagcctttctggagcacagagtgagagacaaacaggaaggcaggcctctgaaggccaggctgaatgtgtattttattctatgtgcactgtgatgaaactttttgagcaaagtcaccataatatttgtgtttttaagaaaggcaacacaggggcaatgagtctcttgatgaaatcattctattttctgtcccaggttttgatgcctgcaagtcttgcaacgtaacaaacatttgcatggggaaatcaagatccatacccattgctggagctttggaagaagttactatgtacatccaatataggatgtacaatataggaactacattgttagctccattcaggaaaaacaattgattcctttttgcgatggggtctcactctgtcgtccaggctggagtgcagtagcacaatcacagctcaccacagccttgacctctcaggctcaaacgatcctcccacttcagcctcccaggtagctgggactacaggcacatgccaccacacccagctaattttttaaatttttttctttagagacagggtctccctatgttgcccaggctggtctcaaactcctgggctcaagcaattctctcgcctcagcctcctaaagtgcctccatgccaggacctgtattgattcttatcagtaaaaatcaggccctgaatattcaaaactaaaatcaagactgtttctacaaatccttctaacggaacatgttcagactcccagactatcctatatataaatggcaagaactttctttcaggtgttctttggaacaaggagccattctattaaataatggctgcagtggccactggctactttcattgagcacttagtagtccatcctttaaagtcaaacacagaatgaggttaacttctactgtgtccgggccctgcttgcttattgacttctaatattggttgaaaacttcaatttttagtggcagatttggatcagctgaagctagaggcagtgacagatgtacaataaggtacccaaggttcttatccaagttcaagccaaaagaaaaaggccaagaagagagaaggagcctgttaggaatagtaactagccacgtgtttaaagcgggcttatatcagaatgtcacaactcataaggactgttcattgtgcacttgtatgtgcatacctgtttaataactacagcatatgttatgtccctttagcatatattcttatgtccttaagaagcctttcttatactagtctaatgtcatttgtgtccttttgacatacatgagctattgatattaggaaaaatcctctctcactccccagtgttttgacagggaatcaactacacagaggatgccataggacattctatttttcacaacaatcgaaggagccaaatgaattgcagaagtcaccatttttaatgaggaaacactgaattggcaaagctaacgtgaaataagacctgactccaaaatctaaaatgtccttgaagaacacttcaaggtctagcgcgtaagtatgccaagcatgaagagttaacagatcaccaaccatcccatgacagtcagtcctccctgtttttagagacagaatctcgctctgtcgcccaggatggagtgcagtggcgcgattatagcgcactgtaaactgaactcctgggctccacccatcctcctgcctcagccccagagtagatgggaacacagtcgccaagtctgttcttgagtttcaggacagggtcaaatgttatagtgcatgtattcatttcagcacttattgagtgcctaataaagtctgggaataatacaactttattagttaagtccctgcccatggcagtaggggagaagcaaggatggaaaccctcaacaaataaatctaaacctatcaaatattaagtcatgatcttggagggcggggaggaaggcagcataagagatttagaggacagctgcggttgccaagatctttctgaggcagcataatacagggcttaagagtgagacctgccgggcaccgcggtggctcaggcccaacacttggggagacctagacgggtacatcacttgaggtcagccgttcgagaccagcctggccactacggcgttaacaccgtctctactaaaaatacaaaaattagcgagcgtggtggttctgtgcctgtagtcccagctgcctgggaggctgaggcacgagaatcactggaacccgggaggcggaggctgcagtgagccgagaccgcgccactgcactccagcccgggctacagtcttgtctcaaaaaaaaaaaaaaaaaaaaagagtgtgggacccattgcatcaggctgtgtaactgtttcttactagctgtataccagtggcaagttactgaaccatttgtgcaaaatgttaatttatttaccaacactgtgttcagcttgccaggcaccgttctccttgaatctcacagcagccctgtgagtaggcactactgttaccaccgtcactttgcagacagggaacccgagggacaaagaagttaagggatttcctcaaagccacagctaggaagagcggcagaactgcgattccaatccatcagtgtgcctccactatccctattccttaagatcgtgccaaaggctgagtcacttgcactaagtagcctagaacagtctctggggaaacgcgcccgccgacaaggatcgccagaaccggcgcgggcaccgcgcggcgaccaggagctctggtcaccgaaggccaggctggaggccagagcagccgcccgcacccggtcaccgcctcgacagtggagacctcagctgaccgcgagcccccggcccgcccgcaccccttctcatgcccccaggaacccgccaagccgctccagcctcacctcctcctccctccatcgcgagatttccaacagcgtttttaaaaaaaaaaaaaaaaaaaaaaaaaaaaaaaaaaaaaccggaaatgggtcctaccatcttctcggagccggagtgcgaagaaataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttggggggaagtaattccggttgttgcaccatggcgtccatggggaccctcgccttcgatgaatatgggcgccctttcctcatcatcaaggatcaggaccgcaagtcccgtcttatgggacttgaggccctcaaggtaatggcacagggacctgctcgcggtgggctaaggggaggtggccgaggccgtggctctgcgcctgcgcgagttgaggagcggctctgccatgtgctccccggaaaggtcgagaatctccgtctccctgcggtctccggccgctcagcccgcttactgagctcgggagacgccggcgcctaatcctgggctcggaatgtgggggccagccaggctgggccgccagcgcccttcggagctgggtggggccgctcagtccggtcgcccgcgggagcaaagcgggaccgcctccccgcccggctcctccagcctgacggccgcgtgggactgcgctccagtgggagggcgccggggagatgctctgtcacctgtcggttaaggcgctgctgcttaacctttcgctggtccacccgcaacggcccttccgttttctttgtcactcgtaaaggtgtggtcacttaacagggtatttcatttctgagtgcttttttgcccacccttgaggaaaaatagcgaagagtgaaaaacggacgcacataaccgtaatacaaggtggtgtgcagtgagaaggacagctacggagagggtgcacataagcgtggtgctggaggacagctttagatcggggtgagaggtagcattctagggagaggaaacggtagaagtaaaggcttgggcaagaatgcgcatggcacgttgtagaatggaagagccatccggttttaatggagcactgacttctttaacttacaatagttcccgaaggtggaagctattgaatgcccaacatggaaaatacgacgttatctttggggaagaaggggagccattgagggggttttgagcagaatttcagtagagctgcacttcaggcagcaaagcttgagatagaccgaagggaataaggaagaccagaggggttaaagaaaccagggcaggggtgcaggtaagaaacatctgagcaccagacgttgacagaaaatgcagaggaagggacactccgagagggccttcagggtttgttataaagtgaattcataatagaccattccactaggtctctcaggtgtccctgttcacttagtgtcttggaggtttacttacgcaaagttagaaacaatacagttcccctatggactctttgtttgacttagtgctagttacacaacctcgcggaacctccttttccagggggaggtgataggcctccgtcaagctgaagacttgacagtgatattaaatggagtgacttagaggggctgcacagtggttgatccacggtaggcactcagtatttgtttcctttctagaaagaaaaagtttcaagctaattgtattatgtattccattttattttccacttaacagggacctgcagagaaaataacatccaatacacacacctggtgtaacaacataactaaaactaggttgttttgcatcagccattttgttcaaactgcatgcatttgtgcccagaagtcgcacactctgagacagggttattttacaaaactggggacttgggcccagagcagttgagaaattgttctgaagagcagttgctactaaagagcattaccatggtcagggccaccgctgtcagagtcaaagccagtggtctagagcagcattctcaagtttggcatattgacattcgaggtcggatcattctttgctgtgggagctcatttggacagtaacctgggtgtttaagtctcttaaaagagttggatgctgttggtaggcatcctgtgagtgttgaggctcagcagtttagggatatacacttgctccctgacctcatagaacgtccagctaacttgaagaaccaaaatatatggaaattgaaggcaacggtaaaagaaatgtataggccaggacgtgaacgttttaatggtaatggtcacagttctttctctctggtcatttagagccttaaaggtaatatgtattttgttgagattcttcacttgtttaacacttaactgtataatatttcaccttaaaaatgcaggcattgactgggcgcggtggctcacgcctgtaatcccagaactttgggaggctgaggcaggagaatcgctggaacctgggaggcagaggttgcggtgagccgagatcacgccactgcactccagcctgggtgacagagtgagactccgtctcaaaaaaaaaaaaaaaaaggtgcaggcattagttggcttaggaaggaatcatattctaaaatcctgtaacctaaaacagagcaggctaagtttccaggccagccagcataattctgttttatccataatatgtattatgccttgatgtttgatactcttccctctggaaacacacagaactagcagaaggaagaaaaaggttttttccacgttgccgagcagtagggcaaaatagatctcgggatttcgggatctctcctatttgccaaattctttacatccttttctttctgcctcttgctttctccttaaaaataataataataataattctattactcaatttggtagctaaatgtgaaaaaaaaaacaggtaacttttttattatcactttgacagctacttaccttccttaagagggccagtttcagccgggcgtggttgctcaaacctgtaatcctggcactttgggcagccaaggcaggtggatcacctgaggtcaggagttaaagaccagcctggccaacatggcaaaaccctatctctactgaaaatacaaaaaaaaatgagcagggcgtcatggcgcgtgcctgtaatcccagctactggggggctgaggcaggaggatcgcttaaacccgggaggcggaggttgcagtgagctgagatcatgccactgcactccagcctttttgagacacagcaagactgtctcaaaaaaaaaaaggccagtcagtaactttgatctataaatataattattgggatttcaggtgggtggaggaagatttttaaagcaagagcagtttttctttttattttgtaatggggtctcgccatgtttcccaggctgatctcaaactcctggcctcaagcaatcctcctgcctcagcctcccaagtagggggggttgcaggctctagtactgcatccagctcaaaagattacaattctgcagtaaatcatagtgtgacagtaaggtgttgtatgtttacagttggactgtttctcatgagtacaggcccctccttgtctgcagatggggaacccgcagatgtacaagcctagatgcaagggacttgagcatctgtgaatttgggtatcctcgggggctcctggaacctgttccccatggatgctcagggagaactgtggctcctggaaccaattccccatggatgctcagggaggactgtgttgcacagtggtcttgcaacgcctgtaaggtcatagtcatactgtccctcttctcagctgtaaatgggctggtaaaagaatctgtctcattaatgtgttgaaaattcagtgagataacacaaagcacttggttctctttctttacgtaagaattgcttattaaaactggagtcgtaaatgttataatacttaaacctgtctgttgccccttaaatgtagaagcttctagacaatagaaactaagtcataagtgatttttgtagtcatcagatgtgtgcttttaaccattgaaattatatgtaacagtgtttgctttttctgtttgtttcattagtctcatataatggcagcaaaggctgtagcaaatacaatgagaacatcacttggaccaaatggtaagagtccaccattccgtgttttttagcaaaagatttaaattataaaactgtcaatataaacctctctacagaaaggtggagtattgaggggaggcatcttacttccttaacacagccaaaattttttagtgtatttcaggtttcttaaacatggttataatcgtgtgcaatattaggtcggacctttttttttttttttttagcatgtaacatcatttcattagcattttccaaatcatagttgtcttttgagattaacattatacttaatgatgctccataatgttttgccaattatgttagccaatctaaaaatgccttcatgcagctactattttgtgtatgttgcattatttgtatataataaattgcacagataagagctgggtcaggaggtcttgttttatagtttgtgatattggttgccagttttttgcgcaaagcctactaaacgttgttttttagggcttgataagatgatggtggataaggatggagatgtgactgtaactaatgatggggccaccatcttaagcatgatggatgttgatcatcagattgccaagctgatggtggaactgtccaagtctcaggatgatgaaattggagatggaaccacaggagtggttggtaagaaaagacaaaacatcctttctcatttaagagacgtcatttaagaccacagggctaacatgcctgctgagattgttgtctctgaatcagagcatgaggagacagacaaatccaagttgaaaacatgctacaaaacaaatgtcggactttcaaaactgacagtgttacaaaagaacagaaagagggctggggattgttaggcatggagaaatgtgtaatgattgattggacactgattttgcttgtcttttaagctataaaggatgtttgggaaacgtggaagaatttgattttggatcatgtactgcaatgctgagtttcctgagtgatctgtgaccattatattgcagatgtgtaggagaatgcccttcttctcagctgtatacctaaatacttaggagtgacatgtcatggtttctgtaactaattctcaaatagttgaacagaaacagtatgtacatgtagagaaaatgtggcaaaatgttaataagtaaactggtattcgttttagtattgtaccttttttttctgaagatttgaaatctttaaaaagttggggagattgaagacaaaatatcagtaaggttaccttttctgcagatgaaatttgaattcattcaacaaatatttattggatactattgtatgccaagcactgttctcggtgcgcttggagagctgtagatttaaacaaaattcatctttgcgaccctaaaatgaggagaaaggaggatgggggtggggggaataaataataaacacgttttagtctcatcaccaggctgaatttcactgagtagaccctggcccaggaaacataatagctttttacctcttagaaaaatgttctttttacattatattctttagttacgttcttcacatcactgagggttgaatgttcatctgtaaggggacacatgtcctattcgaccttcgctagaactaaaacgaggctttcttttaaaaatagagggcttctgcctctaagatgacttgcagcttaattctagaagctgcttctttccatgatagcatctaacttgtgctgattatactaaaagtgaagttttgttgtttgcctgaactgattgtctgctggcttatttgcagtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtgtacgtttcagtagatgatatgattacccatttgtagaggaggcagtttgtttgccatttcttaaaggcaacacaaaatgaccactggtggatttgtatcgatttgattatttgttttgattacttggttttgctttgtttttaatgtagatgtagacagatgcattttgtatttaagttgagaactgaatttctaagttcaggtataaatccccttgacaatatttgcaaaatatagttattttaatttagcagaataggttgtgttaaaaatcagctaaggctggatgcagtggctcatacttgtaatctcagcactttaggaggccaaagcagtagcttgcttgagctcaggaattgaagaccagccagggcaatgtagtgggaccccatcgctacaaaacaaaaaactagccaggcatggtagcacacacttcagcaactccagaggctgaggtgagaggtcgaggctgcagcaagccatgatcatgccactgcactccagcttgagcaacagagcgagaccctgtctcaaaaaaaaaaaaaagtcaactagaaagggtcctacctggaggatatgtgaattttcttaacacttctttctataatttctttgctggggagccattgggggtgggttccactttttattcagcaaattgccgatccaaaattataatttagtaaagagagtcttgaaagcgacttgtctctggtgttttcagcgttcgtgtaatgtccgtttgccaggcttactgccaggtcttatgggcactaagacacagctcttctcccaggagactctaagcaacctcagccaaggggtgcgctgattatgtacaatgccaaagacttaaggtctgttgccgtaatataacataaaaatccagtgtaagctgctttattacattatattaaatcagtgagagatgttttcaattgtgtgcttgtggtggttttagcaaaaaggaatgagggatcttctaaactcagagtagtcagggaaaatgcaggaaaagtgtctgcttctgttgccttttcccctgagcaaagcctatgttagagcagaagccttcagcaatgcctgctgtcctcctctaaccacagatctcagcagagactagctccctaggcaagagtgagtaccctaggggtagcctcttgtcacaagtataacacttattttctcatgaaaggaggacatcatcattacttgaagtgtacaaatcagttttcttgttgctttataagttggccttgttctgtttgcaagtattaagtcatctacttaagatacaacatgtttactttcatggttctcttttatagataacctgtgatttcagacattatttcaagtgctaggtttccctagttgtttttcttggctcaaaaattaatttattgaactgtctattcacatgtttcaaagctttcaaaaaggtaacaccctccatctataatggatgttgtggtgaattcttggaaagtttaaatgccctgtccagtcctttcagttcctggttagtgctacacttcattgagataagagtgactcttcctgagtgattacttacctttcccattctgttctgaacttgtaaaatagtaacagtattctgtaaaagtgctgcattctaagaagaccttaattcatgccagactacagtggtttcttgagtacattcataatggaaggaaatagtaaatttcagagttagcgaaaataaagatgtaattttttcctatctaagtatacagtcccctttagggcccatggatcacaggttaagaatctgccccagactgttgaaaatgcaggttgagatggcattcccctctagaagactcaaaacatcgtttgatttatatctttgagtaacattgtgttatgtggcctgctttggttgcagtaattgtgaaaccaatgaagtttgttttgtggtgttttcctcagggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaagtgagccattgcatctcacagcttcgcactgttggttaactcttaattccaccaattaaaatgtctttatgttcccccatagaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaagtaagtcttaccagagtcctcagtggaatttaaactcccaaagggtacagttagttaggtttggttagtaaatatgtgtagtctttcttcagttctaaaacatacacaggaaaaaaccaaattgcatagaaaggcataaacagggaagaattctaattttgtcttaaaatggtagcgtgttcaggccaggtgcagtggccatgcctataatcccagcactttgggaggctaaggcaggcagatcgtgagatcatcgagaccatctgactaacacggtgaaacgccatttctactaaaaacacaaaaaattagccaggcatggtggcaggcacctatagtcctagctactcaggaggctgagacaggagaatcgcttgaacccaggaggcagaggttgcagtgagctgagcttgcaccactacactccagcctgggcgacagagcaagactctgtctcaaaaaaaatggtagtgtgttcagggtcctgaaagaagtgaccctgttacctaaagccgtgctttcaattgtacatattatatttgccgtcctggacaaatttaacttagcttaccttgcctttaagatttctgactataccttttaggcaagagttaatgagtaactggagttaaaccagaatgcactcatagtaatcccagttctttgctcagttaagtctagtttgggttcatgaataccttagcgtaggtgtgctttctctctgacatagcaactcctctttgggggctgcgtccttgggagttgaaaacaccagtactcaagaagacaggaacgtgggttggttagggtattatttatcatagcaaaccaactagagactattttcatgtctgttcttgggaaagttgttgaatgtactcattgatgatacggttcttggtgcctacgacataccaggctctgttgtaggcactaaaggtacagcagggaatgaagccaagctcgtgctcttgagacacagataagagaaaggtgggtacagctccattacagacactggtcagagaggtgacctgtaaggagaggccaacatagggtgagagcagtgcccctgggggaggagcattccaggctgaggacagatggggatgctcctgagccaggaacattgttggcttgtacaaggaagagccagcctcagggattgaagcatgctggcgggagcttataaataaaaggccatcatctgggccggtgggacagttttcatgagaatggtgcctcagctgtgctggggggccacagataaattgagaggccagggatgttactggatcgtgctggtgaggcgcaggttgctgagaatgagaagggaatgacgatggggctagatagtaaaatgttaaagaatgagaggcagggacccaaagaggaacactgcaggtgactgaggagcaagaaggaccctctcctgttctgagcatgtgagagggaaagcagctgccatctgaggagggttgcaggggcaggttggttttccggggttgtgacggagagattgtataaggaggctgctgttctggactgagttccagagggtcagggaaggaagagagggagagccaggcagtagcaggtagcctgggaggcctgatggagacaggtaagccagagttgtggggcacggtgtggcagtcccaggtgagcaccagaggtggggtgggcagcctgatcgttgccctcctaattgggaaaagtgactttgccatttgcaggtcggggtgagggtgcttcttactggaagcagggttgcctctgtgagtgcccgaattagtttatggatccactgaggattgtccactcaggtgagacagtcaagttgcaagtggttcataacattgtttgtttaaaacatactcaggtgaaactactctgtaggtgtttgtgacaggacagagctgttagccatttccccatggttggggaagggtgttagctttgttgacgtttctgtgggttttgcctcactgtaacaatagggttcagcagaattactgcttgtggtttttaaagcataaacaatgaggtgatccccattgataaaatattcactatttagaatttggaactgacagaaaagtggacacttgtctatttccttccttctctttcctttgcttttgtgtttgagtgcacctgccttacacccaactgtgcctctccttttttcaaacattgtaatgaagaataaatacccactttctcttaatacgattgtggtggttcttttcccagattaaagagactggtgctaacctagcaatttgtcagtggggctttgatgatgaagcaaatcacttacttcttcagaacaacttgcctgcggttcgctgggtaggaggacctgaaattgaggtaggatgttccacgtgaagagactttgagaagtaggggttcatcttatgtgttgaggggtgttttgatagccctgccttaaataactgcatcacaccaaggctggcagatgaggggagggtgagctgggagagaggaaagcgctggaatctttgttactgtttggataacagtgctgtgtgtttctggtgttccctggcattttgaaattctctccctgtgttgtctcacttggccctgtcgttgacttactaaggctggaagacctggtctcatccaaatactaatggcagtcccaggcaacggtgcctcggtggttctcactgcagcgcagtgcaaggaacatgcaggctgggttcccagagtgagggagggctgcacagatgggagatgagggtatgagcttaggggacgggcgccgggtgatagatctgggcagcaccaaagccccaatcaagacgtccagctcaagagccttgttacctagcaaggtgctttgggttgaactggagatgtctcggtcaaagtggggcagcagttctagtgaacaagttggtcttagatcaagttttgctcatttgtggcccagttttgaaagttaacttcaccagtactgtcttcatccttctccctgaccaccccaattagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatggtgagaattcaactatttgtcctatactgttgcttattttgcttcatggtctggcttttttgcctgtgtgtatttaacagagacacagtcaccataagaaaaataatcgtggttctcaaacaatgacgtatcatggtgtaaaattactgaagaccatgttaaattgttaatttcacaaggcacatttgcctttctgctgtcccttagagtatacaatatacactatgagatttttatatctttttaaatacttaaacacagtttaaatattcaagtcctggattttagaatgtttgatacagttacattaggggttggttaaactgctagccctagcaacataagactcattttaattacaatatggtattattaccaaggatgacttacatctgtcccttaggtagaaaaagggaacccaagtgaataaccattgacgatctctgttctttgagaatgagtttttagcacattgtgataaatctttgcgagttttgtcagtttttgactcttgcttgaccgtgtatcctagaatgagtcactggccgcctctgcctcttgaattttgttaactacattgcaggaaggaaagctagaaagataaatattatccgatagtggaggccatctaaatattagagcacagcctctctgtctttaaaaaggtgccagatacttggctctaaattgactagatcttgatcacattaattcaggcaaagctgttttccttagatcattgaggaggcgaaacgatcccttcacgatgctttgtgtgtcatccggaacctcatccgcgataatcgtgtggtgtatggaggaggggctgctgagatatcctgtgccctggcagttagccaagaggcggataaggtaagggatctgtgcagacttagtgaaagattcaggcctcgctgatggtggagactgtgaagctgcggaacagcgaggtgctggatgcaaaacaagcatcgtgagctgtgtgtaggtgacaggtgttttaatctaagttaattcccacgttcctgtattcagattctggttaccataacctagcatttctcagctgttttcagccagttcgtccttgaaataataaatctatagtcttttaatgttatttgaaattcaaaattaatattataacttaaaaataaagccataagagctgctgtattttgagacatctctcacatgtatgtataccctctgcctgtattctgtggtgacattataatattctgatagatacaaaaataaagacagcctgttcttacaattctttgtgagctgacttttcaaagtatgtgatacagttgtgttttcacggtgccgctgggttgttttgtttcgccaagtgcactcaccatacttctgtacctttccagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatggtgaggagctgtcacgcctctgcgtggagggggggggatgtctgatttaaactgaataatcatccactgtatgtgctgtgagatgatggtgtctttttaaatatgtaagcccacttcaggtgttcaagtcctgaattttagaatgtttgattgccgtaggaattggttagactactagacctagcaacatgagactcattgtaataacagtaaagtgcatatggtactatcaccaaagatgacttaggttttaatctctggtttttgggaagtaatgccttattgctgtttttacacagatgtctgtcagtgggcagcatatatataacagctctgaagtgggctttagttcacagttcactgtgtggttaatcctgcacactgtggagtgttttctaaatgtaatatataacctctgtagccacttgtgtagctcggctcccaaaaagatatggtggctgtagcttgttgaaacagtggtctcaggcatttctgtactaaatcaggccatgtctgtaatccatccacagaatgacagcttttgcttaaaggtataggtacattctgctttccatgctcaaattccaagggtttcaatagtagcaactctttgtgaggcaaacatttaatgtttctaacttgaatgcctggttgtgctcaaatttagcatttctagggccgggcgcagtgactcatgtctgtaatcccagcactttaggaggccaagccgggtggatcacctgaggtcaggagtttgacaccagcctgaccaacatggtgaaacaccatctctacaaaaaatacaaaattagccaggcctggtcagggcaggcacctgtaatcccagctactcgggaggctgaggcaggagaatcgcttgaacccgggacgcagaggttccagtgagctgagatcgcactgttgtattccagcctgggtgacacctgtctccaaaaaaaaaattagcatttctagatctttcttggaaatatcttacatttcagctgtggtcagatggacttactttagatttcctaagttagggtatggatactttgtgggataagatgttcctgaaaaatgtcaccctgtagctagtcattgaagacagtgccctcccaacagctctctttaccaggtgcgagttccagagtgtccttggaagtaatgaaattacattcatctgaaaatgaaatataactgaaattagtggcttcctgcttggcttccaggagtttgtatttcttaagtcttactgtgattccctaaatcagaaagagttggttattgatagtttattgtatgctattttaggataatcagtgtccttgtatttttcagatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaacaacctttatcttctcttcgggtttaagaaacgtttattgtaacagtaattaaatgctgccttaattgaaggggtttgggtggatttttttttctcaaaataagctgtagggactattttaacagcttaaacaggagctctcaagatgcactttcatattgagaggaatatgggcttgatcctcttcctatctaaatgggtgggccatttgattgtagagggtccaccacagaattatgggatgccttaagtgctgttactaggttgctcacagcctaacctggcgtgttgtttagggctgatggagacccatgtgagcctttgctttcctctggccccggccccaccctgaacacagctcatacacagaatcaggaccagcatgtgcagagctggccaccagcacaggcttagggcagttcagaacccacttgtttccctatcagagggacacagtgaagtggaggttaaagtaaattacaggaaataagggagaaatcttgcagttaccatgttcagatagagtgactgaaattaattgtacttactaaagtattaactagctaacagtgatgggccaagacgctccgagaactctaccgggattgtctgttctgacaacccagtgaggcagatacactttcttactgctcacatcttacaggtgagtactcataattggccagcatctcaccaccagcaagtagtagggccaggtcaatcccaggcagtctgaccccagagtggcccagctcatcccctactctgttatttgcttgttaatgattctctagattttctaaaataatgtttcttagcattgtgatgataaagctcatgatgaactttatcactagttatgccaccttaactagtcagatttcctagaattaggaaatggtgactcttgtctaaatttggttaagtgatgaatttgggttaccgtctcatgtgaacctggagattcaccagtcttaacttttgggtcattgtgttttctctacattcatgcattggatgttttgctaaataactcctgtggatttaggaatgtgtgctaatagcaatcttcctaattttcatgtttatatggaactatgcagttgagtattgaaagctttaaactgagtttatttacaaggactgagtctagcctacagagaacatacagcagccttctttggaccacagtcttatccgaggggtctgtggttgtatcagaagagccactaaaccaatccccctttccaaaattgaacctcacagacgttcctgttttttgtgattgagaaactggtcaatgaacaggaagacttagagatgtttcacaagcctttgatttttgtttcatttatttgtaataaacctcttccacgtgatgtcttttatttttcacgttccagatcactcaagttttattttgctggtactttggccacaccctctccttccccatgtggagcaaaagcaacttagggtgcttgacccaaaggctagattcccatgtaagtccccatgtattactgctggttcccgatttctacacctgctagattcattggaggtttgttaaatgtcctgtttttaatttcagcctactcaatttctatgtgggggcagttccaggatgtcctgtaggtgccagatttcatggacgctcaagtccctgataaaaatcgtggtatttgcatataacatacatcctcctgtatactttaaatcatctctattattcataatatctaatataaatgatatgtaagtgtcatactgtatttagggagtaatgacaagaaaaaatctacatgttcagtacagatgcaatttttttctctgaatgttctcaacctgaggttggttgaattcagatgagggtcaactctgcaagcagccgctgtgaggcacaaatgtcacagggagggctaagaggcccatctctctgttacattggactgaatttcttgactctcattttctttctctaggtgaaacagctccaacagattgagggttggggggtgtggccagaggaaggtgacacggtagtaactgactaatcagtaatttgtaagcatggagaagtttctccaacctaggtgttccttgcaggcagtcttggcagaatggggtcatctaaaagcaccagaaaagtggggaccaaaggcaaatggccgagaaagtgttgaagggcaggaaaagtggggaaaacacgacaaggtagtaaaaatataaatgtgtgtgccctatcactgctctaaatggtttatgtacattaaaactggttttcaaagtctgctccatggatccctcggggtcctgggtctttccaaggggcctatgagtcaaatgtattttcctacactgaagttactgcccttttcactgtgttgacttttgcactgatggtgcaaaagcagtgaccattaaaaccacaccttagtgtgagtcaggtagtggcaccatacactttcaaaaagaaaatcatctttttggccaggtgcagtggctcgcacctgtaatcccagcactttgggaggctgaggcaagaggagtcgctctagcccaggagtcagagaccagcctgggcaacatacaccctgtctctaccaaaaataagttagttgggcctgatggcatgcttatatggtcccagctacttgggaggctgaagtgggaagatccttttgagcccaggaggttgagggtgcagtgagccatggtcacaccactgcaatccagcctggatgacagagcgagactctttctcaataataaagtatgaatctttgacattgcataatgaaatgtgtcaacaaccggaagatctgctcactagaccaatatttgccaaatatgcatatgatgttacagcatcatgcataggtaccagaccttttcaagatgcaagatggaccagtgtgacagaagaaagtgtattcagtctatcacttgttgggttttggtgcaatatcgaagaatatccagttttgtgaaaggcaattaaaatacttctcccttgtccaactacatatctgtgtgtggccagatcttcatattccagaacatgctgtggccagacacagtggttcatgcctgtaacccaagcactttgggaggctgaggcaggagtatcgcttgagcctaggagttcgagaccagcctgggcaacaaagtgagactctgtctctacacaaaaaaaattgtttaattagcagggcatggtgatgtgtgcctgcagtcttacctacttgggaagctgagaaaggaggatccctcgagcccagggggttaagctgcagtgagccatgaccatgctgttactggcgttgaatctgcacaggtctgcaacagcctcaattctcgcctcctcagaagaaagaattcggctgaggggcataacgcaggagagaccaaggcaagttttagagcaggagtgaaagtttgttagaaagctttaggccaggcgcggtggctcacgcctgtaatcctagcactttgggaggccaaggtgggcagatcacttgaggtcagaagtttgaaaccagcctggccaacgtggtgaaaccccgtctctactaaaaacacaaaaacattagccgggcatagtggcaggagcctgtaaccccagctactcaggaggctgaggcaagagaatcgcttgaaccagggaggcggaggttgcagtgagccgagatcacgtcactacaccccagcctgggtgacacagcaagactccgtctcaaaaaccaaaaataaaaacaaaaagctttagagcaggaatgaaagaaaagtacacttggaagagggccaagcgggcaacgagagatccaatgcagggttgggcctttcaacttggggttttatatgttggcgtacttccagggtcttgggttacttctcccgattacaccccaggcatgggctgtcgcatacacagtggcctgccagcacttgggagaggagcagggcagtgtgtttactggagttctacacatgctcacttgaggccttcttcccttaccagtctagcattccagttagatgacgccattttgcctcttaatgcgcatgcttgagcccacctgtccaactcctgagatgttgtcaggaagctgctcatcaccagtttcaggtgttttctatctattgggagactgcccttcccaggcaccggctgtgaccaattgttattttagggagacagttaacaaccgcctgaccatcacctgagggtcagctggcatcacctgagggggcaaagggttaggggccactctttctgccctgctcatgcctgactagctacctactgttaacagtgtcactgcattccagcctggtcaacagggtgagaccctgactcaaaaaaaaaaaaagtgtaaaagaatcctaaaaccaaaacatttgatcctcatcataatcctagtcattgacaagtccaagagacactgcataatttgaatggaccactcccttatggaaataaactttttaactttatatagttttcagtataagcagctgaaaatgtgcacttagcaggatgtcttatttatcacatgatcttgacgcctactgcaaagacgcaactgaagccagcagtgtggtctttcagctcctcggctcccacttcgtttgcagcagttcatcgtccctcacctcctgtgagaggcagaattctaaacctgtgctcccaagagcccatctggttattccttcaggcactgatctagatactgtgagaagggacttcacggatttcattaaggttaccaatcagctgaccttaaaagagggcaattatccaggtggttccaatgcagtcacacaagcccacaggggctcacagataaaggtgaaagatacagcaggagactcaagagatggcggccttggcaaggtgcgggcgcccacacctgtaatcccagcacttaggaaggccgaggcaagttgatcacctgaggacaggagttcaagaccagcctggccaacatggcaaaaccctggctctactcaaaatgcaaaaattatccgggcatggtggcaagtgcctgtaatcccagttactcagaggctgaggcaggagcatcacttgaaccctggaggcggaggttgctgtgagctgagatcacaccactgcctgggtgacagagggagactctgtctcaaaaaaaaaaaaaaaaaaaaaagaacaccctgaggattccacatgccattgctggctctgagatacagggaccatgtgcaaggactggaagctctgggaactaagtgtggcctccagctgacagccagagagaaaacaggaaccctgatactacagtcgcaagaaactgaattctgccaaaaactcaaatacacttggaagaggctttttcccagagcctcctgacaggaacccagtgaaccaacaccttaattttggccttgtgaatcccacagcagagcaaccagccaaggcttctgatctacataactgtaaagatataaatttgtgtggtttaagttgctatgtttgtgaaaatttgtcacagcagcaatcggaaacgcatatgcttctgtcttgcctcagtgggggaggggagagggaagggtatcttcctcctgcccgagacaattccaatgtcccattgattccatctctcagagcttgtttctcatttctgcatctgagattgtctttagtgctcctcaggatgcgttctggacttatagtaggattgcactgcccagattccttgtggttggatggggttctgtgactagtgagggtctcagaatacaacaccccaaaatgaaggcttcagaagcagctctctctgacctccttccctcctgtttctggcccttcattctgccctgaagctgaaaaccagaatccctcttcccctaggtggtcatagaaaccagaacctctttccctcaaagccagccacaaaacctaaaactattactctaaaaccaccccctgttgccacttccctgtaaaaactggccataaagaaattatctgacctatcttgtttgcccgtaattcataagacccccattccagagagggtcctgtctgataaccagaaggaagaaatgctgccctgagaggccaagaagagtctcaccaggccttgctggggcccccactcagtccactggcattagatcagaccctttttctccaaccgtatttccacgtgctgcccacactttgttgaacctaagcaaaaaaatggacagttttgtggctcatgactgtaattccagcactttgggaggctgaggtgggaggatcactggagcccaggaactccagccaatctgggtaacatagtgagagttcatctctacaaaaaacttaaccgggtgtggtggcacgcacttgcagtcccagcaacttgaaaggctgaggctggaggattgcttgagtccaggagttggaggctgcagtgagccatgatcacaccaccgcactgcagcctgggtgacaaagcgagaccctgtctctaaaacaaccaatcagtaaaggacaatttcccctgtgtctttgggtcatcgttctgatggctcccatgtcacataaaactatgatcaaataaatttgtatgccttttttcctattaatctgcctcttgtcagtgactttcagagggtgatacggaagttttcccttaacccctacgctagtacagtccagcgtctgtggcagcagtatgatttccaggttagagcatgtacatgccaaggcaagacccttcaaggctcactcttctgagcacacagcacagtgcactattcaaggcagtggctgccccatccgctgaggctccccagaggtgaagatgatgtaagtcctctggcaacacgcaagggacatggaacatggtaagaatccagctctttgctggtttagaccctgagaataggctcctcctgtctgtaaatctctcttacctacacacacagcctcccctcctctgttagcactttccagcatgaatctcaccttaaaaagcaaaaaccagccgggtgcagtggctcacacctgtaatcctaccactttgagagactgaggcaggaggatcacttgagttcaggagttcgataccagcctgggcaacacagtgtgactctgtctcttaaaaaaaaaaaaaaaaaaaaaaaaaaaagccaggtgtggtggtatgtacctgtagtccctgctactcaggaggctgaggagggaggtttgcttgggcctgggagacagaggttgcagtgagtggtgattggaataccgcactccagcctgggcaacacagccagatcctgtctcaacaaaaaaaaaaaaaagaaaaaaaaccaaagcataggaaaacaaaacccttcaattgtgtcccctggagccatctcttcctgttcactccgttactctgcagcactgttgtcagccccgcttcctctcctgccttccaccttctgctccctccacccacagcgatggtctgtggaccccaccctgcatagaaaccactcgtgctgcaatcactgtgtccttctgctgcaaatccctggggtgctctctgagttggagtcctctttctcacacacacaaccttttcctgtcttttttttaaaaaaattctcttcctttgtgaagctcctctggtgactttcctggagctctgccctctagttgctcctacatccctggctgctccccacctctggccgtccccctctgcggttgccacttaatatgcattcagggagaactaccctgggtccaccagcatttactcaagggtgaggcatgctgatgacacttcacctactgttaccagtgtgaatctgaagggtctacatcaaatcaaatccttgcctcctcgaatgaaagaattcagctgcgggtcgtaaggcagagggacagactgaggcaagttttaaaggaggagtgagagtttatcaaaaagttttagagcaagaacgaaaggaagcaaagtacacttggaagagggccaagtgccctgtttggtctgtgacttggggttttatacgctggcatggttccgaggtttgcatttcttttcccttccaagggaaaactcccaccaagtctctcccatgacacgtggggattatgggaactacaattcaagatgagatttgagtgaggacacagccaaaccacatcagtcaggctcacatctctgcttcctgttactgtgctccttccctctccagaggggccgaactttaatctttctaaaatgcaaataccattgataagttctgctgctctcatctaaaggcctgaaaagcacatccccaccttgggactcagaggggccagccctaccgggactggctgcccttttacagaagaaggggtggggtgatcctgaggccgcaggcatccttcttgcttggtcttctagaacaggaatgcactgagtttgcaggttgctggcgccccaggactgataagactgcccacgttggccaggcattgggataactcttcccttggagcaggctgtccaccatcttgcctcttagggtgcatgcttgggtctgcttgcccaaatcctgagatcttatcaggaagctactgatcaccagcttcagatgtttctctctatagggagactgcctttccctggtgctggctgtgaccaagtattattttagagagacagtttaacaaccacctgaccatcgcctgatggccacctgacattcctggggaggtagacctctcctgccctgcttatgtcttcctgactacctactctaacaatgcacccctgcagagttatgttattttactgagtttatagcttttacattgagaaaaactgagggtcagagaagcacattgcccaaacccacaagctaaacatgaagcatggatacacccagcttttccctcctgagcctcctcttctcaccctcgtcttcctcacactctccctctgccatacccgccacagccacctcatggatgactcccaacgttacagagccacatgggtctcatacaactgccccccacaaccagcctccacactcctcttcatagcccaccaaagcccagctctgtccagagggagcgcaccccatccctggctaagtgagtcagggtctaatccaatcccgtcaccaattccccttcagctgatgcccaggtcctcggcctctcccatgacacagggggcacacagctgggggatttccctccctctctaaaacagaggtgcaggagagagctccttccttcccttcctgttgtggctgggatttgtaaggccctagggcccagagaatgcagacaccaacccgggtcctgacaccaggaaacccccaaaccacctgagatccctggaggactgtgtgggagatacttaaatgttaccctcttagccactgtcagtcaggttttctgttatttgcagcccaagaaaactcaactgatattccaggctgaaccaaacttaaattgtttcctcacagcccgcttctcttcaggattctgtgctggataatttgtgctggataatctctaagccaacctcagggtcttgcttcttggtgtcctctcagtctctgcagtaaaagcagttgcatctctcagcaactctccactctgctgcctcggtcagtgtattagtctgttctcacgctgctactaaagacatacctgagacttggtaatttataaagaaaagaagtttaattgactcacagttcagcatggctggggaggcctcaggaaacttacagtcatggtggaaagggaagcaggcacatccttcttcacatggcagcagcaaggagacatacagtgcgaagtgggaggaaagcccctcatgaaaccatcagatcttgtgagaactcactcactttcatgagaacagaagggaggtaactgcccctatgatacaattacctcccaccaagtccctcccatgacacgtagggattatgggaactacaattcaagatgagatttgagtgaggacacagccaaaccacatcagtcaggctcacatctctgcttcctgttactgtgctccttccctctccagaggggccgaactttaatctttctaaaatgcaaataccattgataagttctgctgctctcatctaaaggcctgaaaagcacatccccaccttgggactcagaggggccagccctaccgggactggctgcccttttacagaagaaggggtggggtgatcctgaggccgcaggcatccttcttgcttggtcttctagaacaggaatgcactgagtttgcaggttgctggcgccccaggactgataagactgcccacgttggccaggcattgggataaaaacagccccaatctggaactcaaggagaattaaggtctcacctgatggagggagctgcctgtagggcccaggcctgcatgggagggaaaagaaatggcctttttggtgtctgcagacatggagaggggctaagcggaggcacagatctaggcttgaggagtttgccaagtaaataaatgatctggctgtaattgagaaaaaccatgttaaccaaaaagcgaccaaggcagctgtcaatccacagaggtttatttcgccaaggttgagaacgagcccacgaaaacaaccacaagccacagaaacatctgtgagctgtgctttttccaaagggggtctggggcacggcaatatttaaaaaggcaagggcaagcaggagggaaaagacgggggagggacgcagtgaggcagatggtcgcattcttgtgaggctctgagtctcagtaaatctacattttacacgtgaagaaaggaagcacaggaaaagtcaattatgcatttgtctcagggatgatttctggtcttgtctttgtcctctctgtgaggatcacctggtaattgacatcgtcagggtgagatccaaaaaacttgtttcagggctagtttatagggggtggatatagcctgaaagatctagctgctcacaaggaatttctgtgtgagcgctttgggagggaggccatctggggagatgtgtggccttccatggttgtgggatcctggcttacggacgaggctctaacacagggttgtgacattgcagctgtctgtttgggaaggaaaggaaggcagtattgcgcagttcccaagctgaactttccctctggcatagtgactttcgggtcctgagcgtctattttctttcacaaccagctgcagggctgccataaggcggacaaacaggattaatggaaagtcaacaggatgcagttggggatgcgaatcttcctcgccagtatagacttgcaggtgtggccagtgactaccctgctacagggttagcactcctggggaggtcaacttttcatttcattttaattcacttaaattaaaaaactgaagcagtgtaaaatacttctcctgggctgggcgcggtggctcatgcctgtaatcccagcacttggggaggccgaggtgggcggatcacttgaggtccacttgagaccagcctggccaacatggtgaaaccctgtctttactcaaaatagaaaaattagctgggcgtggtggtgggcgcctgtaatcccagctactccggaggctgaggcagaagaatcacttgaacccgggaggcggaggttgtagtgagccaagatagcaccactgcactccagcctgagcgacagagcaagactctgtctcaaaacaaacaaacaaacaaaaaacttctcctgaaaaaacgacaagaaaaaatattgtggaaagctctgttgatcccaccacactcggatctctgttcagtgtgtgctagaccctctgacctcgatgctgtcagcactgagatgacagtgacacaaaagccagtaaattcacttaatttagattgacgtcattttgaaacggatacgcttttgcttcaaagtcaaatcaattgttctaaaacaaatgaagcagttttgtcaatgtgggaggtgaactgtaaaggaaatgacttttgatgctagactcagttatcggaaaacttaaatatgtaaatctacttttctcaactgtaaattttgtgaaatctaaacataaatcaagtacttttttttgttttttttttttttgagatggtcttgctctgtggcccaggctggagtaaaatggcaccatctcagctcactgcaacctccacctccgggtttaagtgattctcctgcctcagcttcccaagtagctgggattacaggtgcccaccaccatgcctagctaatttttgaatttttagtggagatggggtttcaccatgttggccaggctgatcttgaacttctgacctcaaatgatcagtccacctcagactcccaaagtgctgggattacaggcatgagccactgtgcctggccaaatcaagtacttctgatgaaaagttagcatccaaatggagatatgtgtaagcagaaaatacacaccagatgtcaaagatagaggaacaaaaaaaaaaaaatacaaaatatctcactcatgattcgttacattgattacacactgatggaacatttgtgataaattgggctaaaatgcattattaaaattaatttcacttgtgtctctttcctttttttaatggggctataagaaaatttaaaattacatacatggggaaaaaagctaaagttgccattttttccctttaccttcatttatctgtttgtctaatagtcactgaagaacatatctttttaaagaagtacgtgtgtgacttacattatacttctatctgcagtgctggttcagaacaccatgacatttgaccaaaggactcagcagagggaaggctgcccaggccccaagctcaccatgaaggatacagccacacccttggttcattctcgcacgaatttcagacctcccacctatgttgaagactctggctactggccacatgctcaccgacaccgttccacggcaaaagcccagcacatctcaggggtttcctgggaggccggatgaatgtgtgaggcctcctgggagcagccctcagcaggcaagggctttggcctgttggggtccacaactaagtgtccacagtagaccagccctgctcaggcttggattctctcaacattaggcaaagggtctccccatacccatttgacagatgcaaaaactgaggctcaggaagctcaagtttgggaattctttgaattttatgtttcctgagcatctatttgaatgtaagttggactttctcatactagaagcagggattagtaacacagtttccagttatacaacttctcactgttccccaaggtggtcgatccagacatctgccttacaaaaccgcctcctgggaccaccttcccatggacagctggataccacctgcttgacttgtcccactgacccccacacccacatggaccatgccgatatcctacccacaccgacccctctcagtcacagcgtgagtccccggggctcatgcctgcttgctctaaaccccccagttagaacctccaggggaaacctgcatagatgacaccctgggccccagtgaaggctttggctcatagctccctctctctctcgttctccaccttctggttgagcccatgtgtcctgaatggctccccctttttgctggccctgtgaagcgtgctgccctctgttctctggatctgtaagcaataaactgcttctgtcatttcttgggttctgatgagttgcctcctctaccccatcctaacttctttcccggtcagggctctccgggagagtggctgtctcagtaggaataaactggacacaggtcagatgagagccacaaggtcatgtgccaggataaacaagcttcctgcgagagggacacctggccacaggttggacactcaggaatcaggccgtctgtgaggtcaaagaaggatcccatgaaaggcacatgggaaacacccacgaccacatccccaggatccccgtcagggcagggctagagtttacagccactctctcctgagaaggacgtcaagacaaaattaggaaaaaaactacaacatcaagtcacttgcccaaagtcacatgtacgcaccccgtaggtgcaggtgcagagtttctcaccggctctcccctttacgccaccaccagaaacacaggagatatttctgaggtagcctcaggccctgggacccaaaaatgccagtgcttggaaatccactgcttaggagacaacagctgggtgacaactctagcccaccgttctctgctatctttttaaaaaagctgcaaattcaaaaattcaaaaaattagtttattagcttaatataattaggtcaatggaatcctgttttgatctcaatacttcccatattgcaatatataaatgtgacaaattcagctgttttgtggcatagataagtgtctaagctgggcagttagtctacccgtttatagttcatgttcttcatggctttgcagcatttgtcactttctatgatgtgttcaaagaccagaaaaggccacacttgacctgtcagctggtccttgaacagctgtaggtttttttttttttttgagacagagtctccctctgttgtccaggctggagtgcagtagcgcaacctcgactcactgcaacctctgcctccaggttcaagtgattctcctcctcagactcctgagtagctgggattacaggcacatgccaccatgcccggctgatttttatatttttagtagagatggggtttcaccatgttggccaggctggtcttgaactcctgacctcaagtgatccacccacctcggcctcccaaagtgctgggattacaggcgtgagccaccgcacccggcctgtaggttttaactaataattagggtattactctatcattctctatcattcaaattctccaggtactgacctggtttttattttatttatttatttatttacttatttatttttgagacagggtctcactctgctgcccaggctagagtacagtagtggcacaatcttggctcactgcagtctccacctcctgggttctattgattcttgtgcctcagcctcccaagtagctgggactacaggcgtgcaccaccacaccaggctaatttttgtattttttgtagagatggggtctcaccatgttggccaggctggtctcaaactcctgacctcaggtgatccacccactttggcctcccaaagtgctggaattacaggcatgaggcactacacctggtcagaccttgtttttaaattatgattcgatgtacatgtcaaaaattaaattatttcatgcattacgtcctactgaatttgtgtttcaaatgaaataatcaattttaggattcctacacttattttataaaagtgaaaattaaatcaaatgatctaactatttccaagcaaattttgggatgaaagctattctaggaaggcttgcccttgattcttgctacatgtacttgttcagccactcaattaaattccttctggcctcgtcaatgtagggcttgtctgcaggtgagcaatcttctctcttccgatgcacgaacccatgagtctgcccagaaaatgttttaatttgatattcaactttgcagtgttctttcaacttctgagtcagcaaagatacctggtgtgcaaaagatttcatgattttaaccctttagtgatactttccattctccaaatctttagtgagcgttcataacagaaatttaacatcaatgctttaaatcagaaacaagttccacagttacactgaattctttcccactaatttttttctttttagacagggtctcactctgttgcccaggttggagttcagtggcgccatctcagctcactgcaacctctgcctcccacattcaagtgattctcctgcctcagcctccggagaagccgggatgacaggcacccgccaccatgcccagctaatttttgtatttttagtagagacagggtttcaccatgttgaccaggctagtctcaaactcctgacctcaagtgatctgcctgcctctgcctcccaatgtgttgggattacaggcgtgagccacggcgcccggcctctactgctaattttataactaacacagtccttatgtctggcaaaggagagatttcagggaaatggaaaaatgatacatctattatttgaaatcacttgcattaatatattagttactaatattataacaataatttctaaatgactgcttttttttcttaagagtcagggtctcactctgtcacccaggctggagtgcggtggcacaatcgtggctcactgcagcctccaactcctgtgctcaggcaatcttcctgcctcaggctcccaaatagctgggactacagatgtgtgccaccatcccagctaatttttttatatttttgtggagaagggatctagctagactgcctagcctggtcttaaactctcagcctcaatcaatcctcccacctcagccttctgagtttctggaattacaggcatgagccaccacgcccagctaaatgactgcttttgaaccatacttttcttctgctttttccttatcaactgactttgtttaataaatccttgtctttaaggtcacagactttattgtaatttgtgggttagcatggaggtggggcaagaggtcccgtttctccaccaggtaaccaggccatgctgagaatacttccctcagacatttccttaagcatgttttgggaaggttatacttccacactggaattatataagtggaattgaataaaacccatctttaaaatgttaatgttggaaatatttggagcaacaaatgcatccttcaagacttcccactccccgcagaatgtcaaaccgtgctattaaatatataaatgaggccaggcgtggtggctcacacccataatcccatcactttgggaggccaaggcaggcagatcacctgaagtcaggagttcaagaccagcctggtcaacatggtgaaaccccgtctctactaaaaatacaaaaattacccaggtgcggtggtgggcgcctgtagtcccagctactcgggaggctgaggcacaagaatggcttgaacctgggaggtggaggttgcagtgagccgagatcgcgccactgcattccagcctgggcgacagagcgagactccatctcaaataaataaatacgaagagaaaagatgccaacttacgtccttgagtggaatcacaacatcattttcagcaaaaatgaacaaagtggggttctttaaattgtaaatgtcttcagaatccttgacaatgcctgaaaaacaagcacagaggcatgatgtctgatccccacactcatgccacatgatccccacacccatgccgcatgatccccacactcatgccacagaaaactgcaacatttgggtttgatttttcaaagtaaaatctctgctttgcggactttattttcttttttagccattccacagaagtggccccacttgtaagattagcgtaaaagaaggccgggcgcggtggctcacgcctgtaatcccagcacttcgagaggctgaggcaggtggatggcttgggctcaggagtttgagagcagcctgggtaacatcgcaaaaccctgtctctacaaaaaatacaaacataagccgggtgtggtggtgcatgcctgtagtctcagctacttgcggggactaaggtgggcggattgcttgagcctggaaagttgaggctgcagtgagccgtttgtgccactgcactccagcttgggcaacaaagtgagaccccgtcaaaacaaaacaaacaaacaaaaaacccaaagcctgggcgcagtgactcaagcctgtaatcccagcactttgggaggtcgaggagggcggatcatgaggtcaggagtccgagactagcctggccaacatggtgaaaccctgtctctactaaaaatacaaaaattagctaggtgtggtggcacgcgcctgcaatctcagctactcgggaggctgaggcaggagaatggcttgaacccgggaggtggaggttgcagtgagccaagatcatgccattgcactccagctctgggcaacagagcaagactccgtctcagaaaaaaaaaaaaaaagaggattataagagtacaagagaaatttatttagtcagatcctcctactgtctacctccccactttatggactgggaatcaggccattaaataattgaatgatacctcgtccgctgcttagtatggaaagatgcggagcagcctgaggaatgtcccgctgggatgtaccttcgtttacaaagaggatcaatgtcaaaccttcgcttgagaagtttctcaggtctacacaagtcccacgggttctggcttgaatgcactgagtagttttgttggtaagaggagctgtcttttgagtgggtatttagactcgcaccagaccacgagtgtggaagtgtggaagtgtgaaactgcctgggcctagcaggtcagtctataaaaatcagtttttggccgggcgaggtggctcacacctgtaatcccagcactttgggaggccaaggcggggtggatcacttgaggtcaggagttcgagaccagcctggccacccacgcaaaaccttgtctctactaaaaatacaaaattagctgggtgttgtagccccagctactcaggaggctgagacaggagaattgcttggacccaggaggtggaggttcagtgagccaagatcgtgccactgcactccagcctgggtgacagaacaagatgctgtctcaaaaaataataacaatagttttcatctttcatctcagcattcattcgagattaattctgaaattagaagcatgctctgcctgacccaggttgtctgaaaacaacctgtgggtgtgtccacttctatgcgaaaataagtaagtaaaagatttgcagcaagttaaccattttaagataagaagacgtaaataacataacttttttccacttcctgctggcagcagaagagctaagtaacagagagagcctccttcacctgtaactcctcttcaggaggcagggagccacgggaaaggtgaccacgctcccttccccactctagcaaagctacttcatgtggatgggcctcttttgatatccctgggcctgagcccggccacgctctgcagctcacgcactacacaacagcggccagaaggtggcgccggggaggcatccactcccgaccgccttttgctaaatcgcgcaaaagcatggtctggacaaagcatctctcagctccattgttcccagaggcagctggccactgccttttgagtttatgtccttttgtgttgtcctaagtcaatatttaaaggcgtttttaactctaaaagtagttgaaaataccacaatgaggaaccattaacccaagaaggaatcattagtataactttatgatccacttcagatggtcccaggcctaacgatggttccactttcattttttgactttacaatggtgcacaagcgacactcattcagtagaaactgttccccaagtacccagacaaccattctgtttttcactttcagtacagaattcaataaactgcatgagacattcaagactttattataaaataggccttgcgttagatgattttgcccaactgtagcctgatgcaggtgtttcgggtcggccaggtgaggctatgatgcttggtaggtgaggtggattaaatgcattttcgacttgagatattttccatttatgatgggtttatcaagacttagccccattgtaagtagaggagcatctgcattatttttaaaggctatatttcctatgtgtcttttttgttttcgtttatctattggtctgaatgcttctatatcatgaatttagcaagcagtttctatatacagatataatgttatttcattgctgtagtaactttggtttgttttggccaaaaatgtataaattgctatttcgattttagagtgtgttttccttggctttctttccttttttttttttattttttattttaagagacaaggtctcactccctgtcatccaggttggagtgcagtggtgcattcacagctcactgcagcctcaaacttctgggctcaagtgattctcctgcctcagcctcctgagaggctgggaccacaggcatgtgccagtacacccaagtaatttttttctttttcttttgacagagtctcactctgttgcctgggttggagtgcagtggcacaatcttggttcacagcaacctccacctcccgggttcaagcgattctcctgcctcagcctcctgaatatctgggactacaggcgcccaccaccacgcccagctaatttttgtatttttagtagagacggggtttcaccatattggccaggctggtctcgaactattgacctcatgagccacccacctcggcctcccaaagtgctgggattataggcgtgagccaccacgcccagccttaaaattttttatagagacaaggtctctctatgttgcttaggctggtctcgaactcctgggctcaagccatctgcccatcttggactcccaaagtgctaggattacaggcgtgagtcatcgcatctggctgcctttgctttctttcttagtgtgtgtgcatgtttgtgtacagttagagcaatttgtatcttggaaaaatcagtctttctttctttctttctctttctttttctttttttttttttttgagacagggtcttgctctgtcacccaggctggagtgcagcggcatgatcatggctcactgcagccttgaccttcttgggctcaagcgattttcccacctcagcctccggagtagctaggactacaggtgcacgtgaccacgcccagctaatttttgtattttttgtagagacagggttttgccatgttgtccaggctggtctcgaactcctgagctcaagtgatctgcctgcctaagcctcccaaagtgttgggattacaggcattagccaccaccagaaaaatattttcatagatgttgctcataaaaatcttgtgtgatattgatcatcattacattaaaaaaacaaaaaaagctatccccttcatcctaggtgaagaaatggagaatttagattaggtggctttcccaaagtcacaccactgggacccagacctcttgactcccggtgacatcctctggttaactgcatgacaaacctccacctctattttcagattcttaaaacccatttccataagatgggcagtcttcacattattgggggttgtgttacactggatggggaggcttgtgattgttgtcactcttccacccctcccttctgcatggagtaaaaatgcacaaggcagatttaccatagacggacacccctgccctgaattctgagtatttcatcatcaaatgatggacagcagttccaccccagcagaatcccacgatgccaattttctgggcatgacactgttgtttcagatacttcaagatagcactgatctctctagaacagaaagaaaaaatattcaagaatcaggcttattttgtgaacccctcaaagagctgtgctgatgataacagggctgtatcagcaactgtttttgaagttgccaaggtttcttcttttgggagctccacccttactacctctggcccaactgatgcatcatcccagcacatcttcctgccaagcccagccctcctccaactgcctgacagctgcaggcaagctgggctcttcccaaaacataggtccaactgcctcactcccagctgagagctgagcagtcttccacagcctggggatgaaggccacagcccacagcacggttcgtaagacccgagtccatgatctgctccctgcagagtgccccagtcttctctgtcccctgagtctcccaggagaagagtctcctctctcctctctcccatgagcagccataactatgggcagacgcccagacactctctgacttcacacgttcactctctccccaaaactccccactctgcattgctcgtctcctccccctgccgcccagtgaagccaaatttggaacgccatcaggactatttcagccatgaggggaccaagaatagtggcccttgtctggcaaatgattcatgtgcaaactgattgtttggaactcagaatacattttcaactagaagcaatgtaccaaagtggaggtgggctgcacacgtatgtttattgtagcacgattgcaaagatatgcaaccgaagcgcccattgaccaatgagtggataaagaaaatgtggcctatatacaccatagactatactcagccataagaaagaacaaaataatatcttttgcagcaacttggatggagctggaggtcatttctctaagggaagtaactcaggaatggaaaaccaaatactgtatgttctcacttataagtggaagctaagctatgagtagattcacagaggcacatagagtgatataatggactatggagactcagaagggggagggtgggagggtgtgagggccaaaaaactatatattaggtaaactgtacactactcggtgacagatgcactaaaatctctattttcatagatggtgctcataaaaatattgtttgatattgatcatcatcacataaagaatgctatccccgctgggtgcagtggctcacgcctatagtgagaccccatctctattttattttaaaatttttaattaattaatttcttttttttttgagatggagtctcgctctgtcccccaggctggagtgcagtggtgccatcttggctcactgcaatctccgtctcccaggttcaagcaattctcatgcctcagcctcccaagtagctgggactacaggcgtgcgtcatgacacccagctaagtttttggtttgtttgtttgttttttgtatttttagtagaggcaggtttcaccatgttggccaggctggtctcaaactcctgatctcaagtgatcagccagcctcagcctgccaaagtgctgggattacgggtgtgagccaccatgcccggcctaaaaattttaattacaaaaaaaatcccagcacttgagaccagcctggccaacatggtgaaaccccgtctctactaaaaatacaaaaattagccgggctggtggcaggcgcctgtaatcccagctactcgggaggctgaggcaggagaattgcttgaacctgggaagcacaggttgcagtgagccgagatcatgccactgctctccagcctgggctccaacagagcaaaaacaaaaaaaaattttttctcctttgtgccaggggaaggattccattggccatggagaagtcctaccccaaggtaaggagtagtgtctgaaaggtgaagcccacccagctctcacctccctgggccacaacgtgcacatggccacgtctgcggataactcacctatcgatcttctgggcatttcttgttttcagccactcagggaagatagaccagtcgccagaggggtcccaaggctcttgccctacaaagaagtctggaacaatggttctgcaaaatatggacatgaattgatcttagtttcagagttgcttgactcagtattttgcttgcatttatttaaaaacttgctacgttggcgattctggctcagagaaaaggaaaagtagtgggtgtgaaggccaattttgatcgcagcaaagcagccacctggcaccgggccaagccctcttaggtttcacaaccgcaggtgcacagcgtctggcagcctgctggtaacccagccctggcaatgaggctatccacagggcacactcccatgggataggctggcatgggatgtggaggcacctgggggagtgggcctgacgtgggtggctttgagggcccctcctgcccctctcagccagcctggggagactcctggcctttcacatgagcctcaggccagagggcacacctggctaacttgtccagtcactatgaccaggcaatgttcccagcctccaccaagacggcgacgaagcacagtttcctatccagagggtatgttctaagacgggcagcagagcacaaacaagcctggccccagtccaggtcgctcttccatgcaagtcaacccagagggatagagccagccgctggggttgagtcctgtttcccaaaatagaattgccacctggttggaggaacagggctcctcctataggggtagaagaacactgaaactggagtgagaaaatccaagttcgaggctcggtacaccccatgctgctgtgtggccttggccttcacaagtcatgtcaccgcttctagcctcattttctcatctgacaaacttgcactgcctaaccccagaggatcctctcgagggcaaaaaaagttgtatacctgtgaaagggctttgtaaaacaggggtctttccttatcttttatgtcctgacccctgctaaaggaccctccgtgaaacaacagaaacagcaatgccatttgatcggctgcttgggccagtgatctggggcagccgcaaagcgctctctttatggcctggtttcctaatctgcaaaatgagagcaataacagctcctccctcaaggggctgccaggaggactaagggcaatgagcccagtcatgccctcagcactgcgtctggctgagcaactgaaactagctatttatttacttatttatttttactgggcttgcccctagaaagttaagtcccctcacatggggacgtgaaaaaggaaaacttcaaggaaggtcttttcattcagcaccgactctgcatcccaccagggtgggcatgattcctttaagccagtttctcttcctagaaaaacaaggtaggctcatcctcgggtttccagcttctccttctgtgaaaacaaaggaaatccagccgtgcaccatcctcagggctcactgggttgatgctttccgacgctggagaggaaggaaggttctggccctcctctgcgctttacaccggggcaaataagaagcaatcgggtatcagccttggccaaaggtggccatggccacttggccagacaaagaggtaaacttggggaggggagcaaggtctcactgtgccacttctgaaccccagtctaattcagagggggccacgaccgtacgtgtatggaccaggaggagccttggacaccctgccgtccaaatgggccgtgaaatctgacacgaggctgagctgttgaaggaccgagtcacgggtccatttgacagcaggtgaggctggcctcagatgtccagtgcctgcgtctggctgaggccccacacgggaaaagaattctcaatgtccagcaagtctaaaggccaggtactcccaggaggacaggaaacccaggaatggggttaggagcaccaggtgggtgtttaatttcccaagacatttcccatctatcttcacggcagtgagatagggaagtttctaatgtacagtagatactgtatagtcagaccgctgtggttttattttttaaagggaacaaaataaaccactgaaatttgtatgaatttaaacaaagaaacacaactttatacatacgtgtatccatttcctgagatcatgtcagctatatatctggtattgggcaactgccagccaaatatatcttgaatgacaatcacagctttgcctgcatcaacgggggatttggtgacataagccttgatgtgctcgacttgaacttcacggcctagccctccatactcaagtctgtggccaatgtcacacggacaaggataagcttcgttagccattgcagagatttaagtcgggctatggagagagaaacatgcgttatattctgaatgctgcaaatctaaaggctataaatggtaagtaaacctcaaatcaagattatagaaaaaaattcattttagctacatctatggtattatgtgagaaaccaatggtaacttctggttctggcaacactgcagagtaaggctatagacactagaaatgccggattgaataacaacaaaacaacaaaaaatagcgatgaaagaactcacagggaaaagggactcttcagggggcaggatcggagaggaaacagaaagccagagtgagggtgacacccacagatgctgacggggcccagtgatgctgggggacaggacccgactcaggagcacaccctaacagtcgggtgcttaggattttgtgtcgacgtgtagaaagagccatcgaagcacatgagacgggaatttgtaagagacccacgcctgcaatgtcgagccccaaaggttcatgtctcacggaagggggccaaagcaaaaggagaagagctccatccgccaggctcaggtgtgtgcgaagaaacccatctccgtctagattctgagtggaagggaaaaaagaaagcaatcctcggccgggcgcggtggctcacgcctgtaatcccagcactttgggaggccgaggcgggcggatcacgaggtcaggagatcgagaccatcctggctaacacggtgaaaccccgtctctactaaaaaacaaaaaattagccgggcgtggtggtgggcgcctgtagtcccagctactcgggaggctgaggcaggagaatggcgtgaacccgggaggcggagcttgcagtgagccgagatcgcgccactgcactccagcctgggggacagagcgagacgccgtctcaaaaacaaaaaaaaaaagaaaagaaaagaaaaagaaagcaatcctcaaatgtataccatgcttgcaaagtaggaatacctggctgagaaattaacacaattgactctgggccagtgaactgcctggaacaccaggcagaggcaaatgcaaatccactttaccacaagacttccacaatccaggccaaaaatacgacccgctgaagagcagctcatcaggaaaacctatacacaaggaggcgatccaaataaacaagaatcagcagacacaacaccctggaggaatttacagtgggaatggggtttgaaattcacctagaaacacttggtgaatcaaactggaaaacaggaaggaattaggaaattaaaaacctgttcattaaaaagcaggaaatgaggcggcgaaagtgggagtagtagaacaaggaatttgatttgtaaatgactgtgaacaatcaactgagataactcaccgccatcaggcctgcctaaatttaaataaatggaaacagattaaactcactagctgagacagattctcaacttggatttttttttgttttgttttttgagacaggatcttgccccggctggagtgcagtgtcacaaacggctcactgcagcctcgacctcctccctgggctcaactaatcctcccaccttagcctcccaagtagctgggactatggcacacaccaccacaatcagctcctttttttagaataaaaattttatacagacaaggtctcattatattgtccaggttggtctcaaactcctaggctcaagcaatcatcccacctcacactcccaaagtgctaggattacaggtgtgacccatcatgcctggttcaaattagactttttaaaaattaaggttccggaccaggcatggtggctcacgcctgtaatcccagcactttgggaggccaaggcaggtggatcacaagttcaggagctcaagaccagcctggccaatatggtgaaacccccgtctctactaaaaatacaaaagttagccgggtgtggtggcaggcgcctgtagtcccagctacttgggaggctaaggcaggagaatcgctcgaactcgggaggtggaggttgcagtgagccgagattgcgccattgcactccagcctgggcaacaagagcgaggctctgtctcacaaaaaaaaaaaaaaaaaaattaaggttccatcaaaaaagaggaactaggaacactaaacccaaagacatatgtaattcccttcatgaacaactggagaacacagtctttacaagcagatgtgaactgcctgcatattaacccacaatcaaagtttcagtaaagattttatataacaaatgctatacaaatacaacgaagaaattataataaaactcaaaagatttagaactggattaccatgttaccatgaaaacactacatagcaaaacttgatacaatcaatacagcagtaattagagacatctttacagcctagactacatatacttgaacaagaggaaagaataaaagtaagctaaatatcaagaagttagaagaaaaaaatagaatgaagccttagtccattcaggctgttataacaaaatacagtaaactgggtagctcataaatgcagaggtttatttcttacagtcctggaggctgggaagtcgcagttcaagggactggcagatgcaatgttaggtgagggtccactttctggttcatatgtggtgccctctccttgtgtcctcacggggtagaaggaactagctggctctctggggtctccattataaggacattccctatagtaagaggtctgccctcagacctaatcattttccaaagacccgacctcctgataccatcaccttgagggttaggatttcaacatatgttaaaactaaaaaaaagaggtaagaaacaagaatagccacaataactgaaagaaaatgaagaaggagaaattaatttaccaaacaacaaaacctattaaaacagtatggtattgctggatagatgaatacatcaatagaacagaccaaagactctagaaccagactcatgtgtattcatccagtcatccacagaatgtttactgaggcaccactctgtgacaaacactgtcgaaggttctggggaaacagcagagcatgaaacaaataaaaatccctgacctcaggaagcacattctagtgggatgaaatatacaaaaacaatatgcttttcagatggtaatcaatgctaagaagaaaaacagagcagagaaggaaagaagacaatgttggttgagggtgtgagttgcaatttacaatggtgtattggggaacagcttgttggaaaggcaccatttgggcaaaggaggcgaggggtggtgccctgcagatatctggaggaagagcggttgagacagaacaaacagcaagtgcaaaggccctgaggtagaagcatgtctgacatgtctgaggaacagcaagaccagtgtggctgcaacagaaagagcaaggggagagaacagcagagaatagtgtgagttcccagagttttactggaagaatttagtttttcctcagtgtgagatagaagccactggagaattttggggaaatgagtggctttatttgacttgatttacagtatcattggcctgacacagtggctcatgcctgtaatctcaatactttgggaggctgaggtgggaggattgtttgagaccagcctggacaacacagcaagaccccatatctgcaaaaaaaaattcaaaacttaactgggcatggtggcacatgcctgtattcccagctactcaggaggctgaggtagggggatcccttgagcctgggaggtcgaggctgcagtgagtcatgactatgccatggcactccagcctggatgacacagagagatcctgtctcaaaaaaaaaaaaaggatcattgaagatgctgttttaagaagaaatcatcaagtagcaaaggaagaaaagaaagtccagttggatggctccagcaacaatccagccaagagatgaagcagctcacaccaggacggtgatggtgagagggcgggaatggtcaagtgtggacagattttacggcagagccactcagttctgctgacagattgtatctgtggggacatcagacaaaaggaggagtccgtgatgactacaagggttcctgcctaagaaactggaggatggagtgtgtttaaatgagaagggatgtgggaagagctggtttgaggagataaggacttcagtttggggcatattaaggctgaggtatctattacacatcccagagaaaagctgggtaacacgatagaagttcaagggccaggggcccaagctaaaacgaaaactttgagagtgatgtgagtatacagctgaccctcattgtttgcagatcctgtattgatgaattcatctacttgctgatttttttttttttttgagacagagactcgctctggttgcccaggctggagcgtagtggcatgatcttggctcactgcaacctccaccttctgggttcaagcgattctcctgcctcagcctccctaatagctaggattacaggtgcccgccaccatgcctggttaatttttgtatttttaatagagacggggtttcaccatgttggccaggctggtctcaaactcctgacctcgggtgatcccgcccaccttggcctcccaaagtgctgggattacagatgtgagccactgtgcctggccatacctgctgaatgtattttgtaacctcaccgtcattcatggacattcgaaaaatgtgaactgtcaatgtccacattcccagctgaggacacacagggtgcaatagactgaatgtgtccccaaaaagtcagatgttgaaaccctaattccagtggaatgatatttggaggtagggtctttggaaggcaagtagttcacaagtgcagagccctcaagaatgggatgagtgccttatataaggggcccagagagctggcttcccttctttctgctgggtgagaacacagccagaagatgaccatctgcaaaccagaaacaggccctcagcagacattggatctgccagcgcctcgatcttggactttccagcctccagaactgtgagaaatgtttgttgttgaagccacgtttgttagagcagcccaactgcccacaacactctgcttctcatttgagctctcacagtgtaaacaagtgtcctttgcatggtcttagtgcacatttttgtgctttttgaggggttgattttgctgtttaaaagggccccgcacttagtgctcacatgctatctagcattgctaagcacgggaaggctgtgatgtgccttatggagaaaatgcgagtattggagaagctttgttcaggcacgagttacagtcctgttggccatgagcttcctgttaatgagtcaacaatatatattagaatggtatcttccacaaaaacacacataaaaccagggttatgtatgggtcaactgaggaaaccgctgtgaccaggccacaggtttacaggaagctaaccttgtattttccccaggaggaatggtttaggatttgctaactcagtgtttgtagggactttactactacaaataccaagaatgactgtatgtgggtttggtttgtttgtttgagacacagtctcactctgtcccctaggctggagtgcagtggcacaatctcggctcactacaacctccacctaccagtttcaagcaattctcctgcctcagcctcccaagtagctggtactacaggcgagcaccaccatacctggctaatttttgtatttttggtagagatgggttttcaccatgttggccaggctggtctcaaactcctgacctcaggtgatccactgtgccgggcctgtaggtgatatttaaactttaagaatgaatgacatccttcagggaataatggtggatgaagaaaagagaaatctagaagactgagccctggggtccttcaacactaacacttcagggagatgggaaggaatcagcgagtgaggaatgagcctgagaaggaacagccagtgacgggggaggaagaccccaagtgtggtgtcctggacccaagtgaagaatgggtgttgaggggagaacaatgaatgctgagtgttgccctccgcgtttggcaaagtgaaggtcattggtgacctccacaaggacaggcttggacgagggcatgggtgacagcataatcatagtgggcttaaaagaaactgagaggagactgggcgcggtggctcacgcctgtaatcccagcactttaagaggccaaagtgggtgggttgcttgaggcctggagttcaaaaccagcctggccaacatggtaaaaacccgtctctactaaaaatacaaaaattagccaggcgtggtggcacatgcctataatcccagctacttgggacgctgaggcaggagaactgcttgaacctgggaagcggaggttgcagtgaaccgagatcacgccattgcactgcagcctaggcaatagagtgagactccatctcaaaaaaaaaaaagagagagagagagagaatgagagaggagagaactaaagagagtgaacacagaaaactcttagaagacttttgacagaaaaaggagcaaagaggccgggcgtggtggctcacacctgtaatcccagcactttgggagacggaggcaggtggatcacttgaggtcaggagttcgacaccagcctgaccaacatggggaaaccccgtctctactaaaaatacaaaaattagccaggcagggtggtggatgcctattatcccagatacttgggaggctgaggcaggagaatcgcttgaaccgggaagcagaggttagagtgagctgagatcgcaccatttcactccagcccggacaagaagatcgaaactctatctcaaaaaaaaaaaaaaaaaagagcaaagagactgtgcaaaagatggagggaagacacagggatgagccttttttttttaaagtggaagaaatctcagcctatttgtacgtggatgagaatgataccatagaaaggaaaacaaacaaaacacaatcaatgaccccgggagagagggaactggagagtgtgacaggagggtctggcgcatagcagaggagctgccttctttggcagcgtggacagtcctcacgcacccaagggaggctgaggacgtggacacagacacaggtggtggtgggtgtggggcgggagagtgtggatgctccctgttggcatctgtttgctcacagaactgagaagcagagtcagcagctcagggtgagaggcgggacgagggctggggagaggataagcaggaaaacaggggaccagcgagaagtacgtatggctgtttcctccagccaggtccagcagtgggaacaggcgaagagcaggcgcagagcaggcagagagagggggtcagatacaatgggctctgtagtcatgagagggggcaggagggacctgtggggggaggagggactggccatcaatggggcacggctgcagcactgagctacccaggtaagaaaacaaatcaccatggatccccacataccccagtgcgtggctagaaatctaagtaggaaaggcgaaatttcaacaatcagaaggaaatactgaatacttttttcttgtactttggaataaggcagaatttcttaaatttgacccaaaaaacataaaccataaagaaaaggattataaatcccatttcatggtaaccaatttaaaaaaaaaggaaagacaactgcagaaaactgaatactaagtggatatttgatgaaattgcaaattattgtgaattttggcaggggaagatgatggcattgcagccatgtgtttttgagtccttgtctttcatagatgcatcatgatatcatgatgtacccacagatgacatgaccagaggtctgggatttacttcagaatagccccatttgggctgagtgcggtggctcacacctgtaatcccagcactctgggaggccaaggctggtggatcacctgaggtcaggagttcgagagcagcctggccaacatggcaaaaccccgtttctactaaaaatacaaaaattagccaggcatggtggtgagcgcctgtaatcccagctactccggaggctgaggcatgagaatcactggaatccaggaggcaaaggctgcagtcagacgagatcgcgccactgcactccagcctgggcgacagagcaagactccatctcaaaaaacaaacaaacaaaaacccaaaatagctccatgtggggtagggtggacaaggtgtccacgtgctgatggtggtgcagctggagtgtcctgtgtactaatctctctacttttatatatgcttgagattttccatgacaaaaagctcttaaaattgcattaataagatagtaactaagatgaaagattaataagataatgattaacattaatatcaagataaaagtctccataaacaaagtgagaaaacaagatagactaggagaaggtattattttaggaacagaggacttagtgtctagataaaatatataaagaattcttataagtcaccaagaaaaagacaacccaatagaaaaattcatatgaatgggcaatttacaaaaaagtacacctgaatggcccataaacatatgaacagatattcaacctcactgttcttaaggaaactataataaaaacaagaatgaaatactattttccatcttgcagattggcaaaagtctgttaacacagagatgatggtacacttgtagggaaatgggagggcatgtgaaatgatacaaaccctggaaggagtctagcaaagttaaagaagcagatgccccgcaccctagatatcccaccactagatgtttccctagagaaattcatgtcacatgtggtgggacatggtggctcatgcctgtaatcccagcactttgggaggccaaggccggggggatcatttgagcccaggagttcgagaccatcctgggcaacatggtaaaaccccatctctccaaaaaaaaaaaaaagcagaaaaattagccaggcatggtggtgtgtgcacctgtggtcccagctactcaggaggctgaggtggaaggattgcttgagcccaggaggtcaagactgcaccactgcactccaggcttggtgttaagagtgagaccctatctaaaaaaaagagagagagagagagaaatttgcacatgcccacacaggcacatgcagtgattatggaaaaatgttcttggcaccactaatatgatgacaacacctggaaccaatctaattgaccatcaacaggagaatgaataaactgtaatttattgattgatgtaggttgaattgtattcccccaaaatacatgtttaagtcctatcccccactccccgtgcatgtgaccttaactagacacagggtccttgcagatgtcctgtagttaagatgaggtcatactggagtacagtagaccataaatccaatgactggtgtccttctaaggaggggaaaacgtggacaaagacacaacagacgcacagaagagaaggccgtgtgaagatggaggtggagatgggaaggatgcacctgcaagccaaggattgctggccccccaccagacgctggaataggcaaggaagggctctcctttacaggtttcagaaagagcagagccctgctgacactttcaatttggactcctggcctccagaactatgaggcactgtgttgctttaagtcacccagtatctggtaatgttatggcagccctagaaaacaaatacattcataaaaagaatattacacaacagttcgatgaacaggctgcacctgtaatttatcaatataataaatctccagacccgcatggtggctcaggcctgtaatcccagcactttgagaggtcgaggcatggtcatagcttgaggccaggagtatgagaccagcatgagcaacatagggagaccccgtctctacaaaaaaatttttttaattagccgggcatggtggcatgcacctgtagtcccagctactcagaagactgaaaggaggatcacttgaacccaagaattcaaggctgcagtaagctatgatcatgccactacactccagtctgggcaacaaagagagacatttttatttttatttttatttatttattttttatatatttatttatatatatttatattttttatatatttatttttatttaaaaatagaaatacaaaacttgaaaaatctcaaagacataatgctatgtaaaaagacatagcattttgattctaaataacaaccaaaaaacatacattttgatgctaaataaataacaaccaaaaatatacattttattcataaatatactgtaggaaaagtatcacgcatgagaatgaattatcaccattaggacaattggttaccgggaagagaggggagaaaaaatggagatcgtgggctttattatgttttatttccctaaaaagttttgatttgaagtatatagggcaaaagggtattatctttcaaatatgggtgatgtgaaagggtggctgttatataattcccttcacattactgaatattcttagtgtttcataattagaaataaagtaattagattttgagaagaaagaaattaataactagttatccaatcaaggacaactggactgtagttttcttggtttggttttcataagctacattatagaactataattagtaagactcaataattcaacattgtcatttgacaccatttcagaaaaactctcaagccatgtttccctctgctctcacaatacagcgatcatcaacaccatgaccaaaggtaaggggtgggggcgcgtggggcagtgagggctcagttccaagactgccccacccctcagacacaagcagcaagttcaggcctgtagagctttctttttttctttttcttttcgggtttttttttttttggagacggagtctcgctctctcacccaggctggattgcagtgcacgatctccgctcactgcaaactccgcctcccaggttcaagcgattctcctgcctcagcctcccaagtagctgggactacaggtgcccgccactatgcccggctaatttttatatttttagtagagacggggtttcaccatgttcgccaggctggtctgggctgacttcttatctgggctgacttcttatctgggctgtttgttggctatgaggacctagggatcacagaaaatcctggccattccaggaagcctctaatctgaatgtttttactttattttcagttgacatccattttgcaaaaggaatgcttacagccaggcgagcagccctctaggctgatcctgcaaggttattctcctacaggagacgcccgtgtgtgtcgaaggctggactcctgcccagaccctccacgtgggcacagcagccaggccacgccttgtgccaggggccaagtccacaatgggcagggcgaacagtttctaccctggcaagtctcagggaacatacccttgactctcaactaactgtactatattttctgtatatacctttcaggattttagcttcctcctgcaaatgcactgtaaaccaaaaataaaattccaagcatcccaactaactgaatggacctctcctcttggccaaggcgattccaaagaaacctgtaaaactaattcaggccatgacaggaaggaggggctaggctcagtggctcatgcctataattcagcacattggaaggccaaggctggtggatcacttgaggcaaggatccaagaccagcctggccaacatggcaaaaccttgtctctactaaaaaaaaaaaaaaaaaattagccaggcatggtggtgcatacctgtaatcccagctacttgggcggctgaggcaggagaatcgcttgaacccaggaggttgcagcgagactctgtctcaaaaaaaaaaaaaagacaggaaggaggagtccaacatacctcattattccctcctccattgaagttcaggcacaaatgaccagcattaacattcaaacagaggtctcaagactgacgaaacagactttttgtagaaataaggtatgaaattccaacctgactcaaatacagcatccaaggatatagacagcaggccctgaaacaaatcaagtattttaccccaaaatatttttgacatattttgaaagggccctgcaaagctatctcttgtaggggaaacttacattctgtagagaatccccttccctttccaggtctctttctgatcctgaaaagattacctgagagtctggcagcttttaaaggtctgaacagaaaacatttgctatctattgcctctaagggtagccatctatgagacttcacctacataataagaactttggtctcccaaacctcttatcttaacccagaccctcctttctattgattccaggtctttcattattaatttaactctttcaaccaagcaccaatcagaaaacctttgaatccccctgtgacctgtaagctaccaccctgaccctgccatccccgatctttgagttgtcccacctttccagactgaaccaatgtatacctcacatgtattgatcgagttcctatgtctccctaaatgtataaaaccaagctgtaactcagccaccttgggcacatgttctcaggccctctgggggctgtgtcatgggtcatggtcctcacatttggctcagaataaacctcttcaaacattttacagagtttgacttccttctgtcaacaacacatgtatttattaaaagataattttcagaaagaagtaaaaccatcactcttcaacagatataaaaacaaacaacattgaggattgtactctacttgaacgacaggaaaaaactaacagatgttctaacaggcttgaaggaaaatcaaaagagcacaaatgcagcactggaaagtgtaaactaaaaactctaagcccccaaccaactgactggatcatctcttcaccaaggagaccccagaataaccttaaaaactgagttattggccatacaactcagttatatagttatgggttgggggatcacacacctctcattatccgctcctgactcactaatcaccatgaggctttcttttctaaaggctaaacagaaactagcctcttcaaacaaccccacactgatatcacccagccgcatgacactgccctcctttttgcctgataacaaaacaccaaccatgacatggttctggcctgtctacagagggtgcacagtaaggatttttgtgtcctctgcttcagcttttaacaacagagggccaaaaataccacccttggatcatgctaacgcagtcattttttgaacatggctcccatgaagaggcaaaaagctcaattgcccacgtacacggttctccttcaaaaatattcatggctgagaacagtggctcatgcctatactcccaacactttgggaggccaagacaggaggatcacttgagtccaggagttcaagacctgcctgggcaacacagggagaccccatctctacaaaaaaaaaaaaaattagaaaattagccaggcttggtggcacacacctgtggtcccagccttttaggaggctgagctaggaggagcacttgggcccaggaggtcaagactgcagtgagccaatgatcatgccactgcactccagcctgggggagtgaatgaaaccctgtctcaaaagtattagctaatccattattttaaaaattcataacccctcctatagcttattgaatctgtgtgtttggccacactgttcagcacagatccctgtactattcttcccacactggaagggtctgtttccagcttctggccagagactacacttcccagcctgtcagaatggccgctttgcgggctgcaacactttatgagaaataaagctctctttttccaaatttatgaaactcatcattctttagttgacaaaagaaatgttgagatgaattgcaaatgaagacaaaatatctttttggccaaacgcagtggctcacacctgtaatcccagcactttgggaagctgaggcaagaggattgcttgaggctgggagttagagaccagcctagacaacatgttttttttttaacttttttccacaggaggggaaagagtccattaattctgcatggaaacgggatagaatttacagatctatcagatctgccacttactcctaaaaatggctcaagtacaatgaatggagctggaatcagacagcccacagggcgtgctatagacatgggtacttttccactgaggcactttttacaaatgatgaggtcctttattgtgagtaagaaggtttccttttcctcctgtgctggggcaggactgtgtgtctgagatgcatgacagagtcctcgttacacatgctgtcaataaaggcttttctgtatcatggcagatgtgtttggggccaccttctggtcatccccaggtcagttctgtggtctccactggtgacgtctctggaaatcaggacgcttttcctagctctgtggagtgccctgcaggacaccctggtggccatgttcgtcggcaatgcccacactggccaccaccagcacaaatgcatgattccccatagacattgctgcaaggtgctgcatatgtgtgaatgacttctatgtgatggtatgcacaggagaggagcatatggaattggaatttgcagatcaaatactcaacagtgatccccatgggttttgatgtgtaattttccagagagatttgcttgtgtgaggcagagctggaggggccacaggagtcactctgtaggggtgaaggagcctcactctgcctaacacaagcatgtccctctggaaaattacacatcaaaacccatggggatcactgttgagtgttttttgttttttgttttttgttttttttgagacggagtctcactctgttgcccaggctggagtgcaatggtgcaatctccgctcactgcaacctctgccccactggttcaaacgatattcctgccacagcctcctgagtagctgggattataggcacatgccaccacgcctggctaatttttgtattttagtagagactgggtttcaccatgttggccaggctggtctcaaactcctgacttcaggatacatccacctcggcctcccaaagtgctaggattacaggcatgagccactgtgcccaatcttacagttgagtgtttgatctgcaaattccaagggtatgctcctctcctgcgtgtaccttcacaaggcactcctttactccgtatacatttgcacttcttgacttcttttttgaaccagttacaacatctgcctatttctctctttaatgaataaaataaaatatttatcacttttatatctgtataaaagtcacgatttcacctttggctgaaaattatcttttaacaatgtaatcaaacattccctttctaacactggcagtcagacaggtaagagaggtgataaagtatggtgagggtgtggttttcctgatttcacgccctaaggattcaaataactcacaagtcagacttccaggcacaacgcagttctccaacagaaatagagaaaacagattttgacaagcaaaagggactggtgcagttgggattataacaagcagggaagtctaggaatacatctccagcctcctgggagagcctgagcccggagggggcagagaggaggaggagggaggtctgggggaagagaggtctgcaaagtaggggaagggaaggccaggagggagggaggcgcagcggggaggagaggagagaagggaggaatacatttctggaagctttagaaatttagaaatagaaaccacgtggaagtgcatccagggctcagggttacagaggaccccaagacaacacaggaaagtggggtctaatgggaaaggcaggaggtttctcctttactgcttaaacattgtaggaacttgcatggcaagtgattttcaatcttgcagcagggaaggcagggccagtacttatccttagatgattctacaaacatcaaacttctccaaatatttatttttcagcagccatgcttgtattttccaagtgtctatggtcgagatagcatgaattaggaagctacctggatgagcccacaatggccctcttagacatgccaacgacgcccctgcagaatctgctttttctctggctgttcctaggcctggatagggttcccaggcctggacaggattccccggataccggcgaggctcattactaaccactttattttaaatgggctttgaaaacaacaggtggcatcttccatcagcaagtggacataaatctcagtgcccagtgtttccaaggcctgcccgacccacatggctgtggggtgtaaactgtccagtcgttcctggcacacctacccagcatttaggatgtcccactcttagatccatagacccagcacctctcttcttaatacccaccctaaagaaaagctgtcgaatgtggatgctgatttagttgcaaatatgctcagttttttaatagttttatattagtaaaaacgctacaaccagaatgtctcactgcaggaagagagttacaaggagtatttaacggcatggtggaaaggctcctccgtgctaaatggccaaaacgaacgcaagtttgcatacggtgtgatttccactatgtctttaaaatgcatggcgaaacacctacaggaaaataccaaaatgtaaacagcggctgcttcggacgcatgggatcgtggaggctgctgttctgcaaggacaacgtatcacttttatgaaagtcagcttctgaaaacggactatgggaagttccttacccgtgcacgcggcaaagaccttctttgccatagtcagaacacacgcgggagttcagaggagcggggcccgggcttgtgtgggcttgtgtgccccggggacgcgcacgtaccttgtcccgcggcctgagactgcgctgcaccgcgcggaggccgaacccagaggaggcggcgtggcgccgggcggggacgcgagagggacgtggacgcggcgaccgaggacgcggggatcctgcgggaccagtggctccagtcgtagcctcctgggagagccaagcccggagggggcggagaggtggaggagggaggcctgggggaagagaaatctgcaaagtcggggaagggaaggaaggccaggagggagggaggcgcagtggggaggagacgagagaagggagggagggaagtgtgaggggaggggaagaagtggggtggtcggagggtggggtagggaggaagagggagggagagatgggagaggctccaagataaagaaaggtgcagggagagggggtgggagggagggaaccgcagagaggaagggagaagagaatcaggcagccttgagggaggaggcagggaggccaggagaaggaagacagccagccttctgtgagatttacgtgcgtgcctggcttccaagacaagtaacttctgttgtaaatacaaattaagctattttttgtttattttattttattttattttattttattttattttattttagagatagggtcttattctgtcacccaggctggagtgcagtgacacaatcatagatcactggagcctcgaactcctggcttcaagtgatcctccccttcagcctcccaaagtgctgggattacaggtgtgagccaccatgcccagccacaattttttttttttttttttttttttttgagatggagtctaaccctgttgccgaggctggagtgcagtggcacgatctcaacctcaacctcactgcaacctccacctcccggattcaagtgattctcctgcctcagcttccccagtagctgggattataggcacgcgccaccacgcccagctaatttttgtgttttcaatagagacggagttttaccgtgttggccaggctggtctcgaactcctgacctcaagtgttccacctgcttcggcctcccaaactgccgagattacaggcgtgagccgccgcacccggccccagccccaaattaagcctttttttaaaaaagaaattaatacacgtttcatacttgcctccttcgtattttctctggtcatctgcccaaggttatgacaacagcttcaacttggctgcagaagcacacccctgtggctcactcaaactggaaacatacaggaaaagggaattctaggaatatagctcagcctggacaaatgggcacattaaaaagccattgcaccgtggtggccgcacttcctgccatccccactgcaaaggtgttgttatggactgaatgtttgtgtcccctccaaaatttgtacgttgaaatcctaaccaccccgcccatggtggtatttggaggcggggcctttgggagatgcttaggtcatgagggtggagcccccaagaatgggatttgtgccgttacaaaaagaggcaagggagcttgcttcctcatctgtatgccaggaagaggatactcaccaagaacccaatcctgctggcccatcccagacttccaacttccagaactataagaaataaatgttgtttaagctacccaagtctatctatgatgtttttgttgttgttgttgctgttgctgtttttgagacagagtctcgctgtgtcgcccaggctggagtgcagtggtcccatctcggctctctgcaacctccgcctctcgggttcaagcaattctcctgcctcagcctcctgagtagctgagactacagacatgtaccaccatgcccagctactttttgtatttttagtggagatggggtttcaccatgttggtaaggatggtctcaaacacctgacttcaggtgattcactggcctcggcctcccaaagtgctgggattacaggcatgagccacctcgcccagcctggtgtttttgttatagcagcccaaacggactaaaacagtgttttccttctagagatacactaattttctttcagacaggatctttcaaaacccagtctgaaacatctgcagttgaattattttatgggcttggaatttctctaaaatagtggttagggattttttaaacatcagaataatttaaaaagttaccaaagtgttattacccagaacaaattcagggtcagcgccaaagaaaaaaatttatttactttttttgagacagggtctcactctgtcacccagactggagagcagtggaatgatcacagctcactgcagcctctacttccctgggctcaggtgatcctcccacctcagcctcctaagtagctgggactacaggcatgtcacccaattaagtttttgtttgtttgtttgtttttgtttttgtagagacgggctttcgccctgttgcccaggctgaagaaaaattcttgtttccatcctacaatgcgcaaattgcttgtgacacctaaaaggacaatttttcaacttcaccaattttagtgccaaactccatggaaaattaatcacacaagtgattatttaacctaggttcttaaaaaaattaagtttccttcttacagaaactctcagcagaaatgaactctaagatttcatggagttccctataaattaaagagctatgactcagcgtttgctgctcgttacccctccaaagttatctttatttttcattataaaataggtaactaaattccagggacagaatgagtccaagctgaattaacaaacagggcaaggtcaaagttaaacaaaattgctgactctgctcaaactcctgtgatttacactgaccttgaaggcaaggccaggaaaagtattccttggaattgctcctctaaagacgcttggaacaaaatcagaaaaagtgctgctgtgtttcagaacatctcaaaataatacctgagggcaaacatattctatgtcatctgttaccatttcctggccgtgctgctgactcagcctccagcactccttggtggagctgcagggagcccgctgggaaagcgctgaatcctgtgcacaggaaaggcactgctggtgaagacaggtgagaggctgggtaggtgatttctagaaggttcttgagcaccagtcggccatcttgtcatccccagatagaaagcttaaatttgctttttttttcactttttattaatgaaaatgtacaaacatatagaaaggtagaaagaagaatacaattaattcccatataccccaggcctaaatataattatctttagtattttgctaaacttgcttcatcgatttttttttcaaaagtgtagaaattatagacaacttgacattttaccccttaataattttgtagtagtcagcctccaagatgactcataacgtgccctgcctctgagaaatcacaaccctatgtagtctcctacacttaccatggttggtctgtgtgaccaatagtctaccaacatagtgatggtgtattagtctgttttcatgctgccagtaaagacatacccgagactgggcaatttacaaaagaaagaggtttaatgggcttacagttccacgtggctggggaggcctcacaatcatggtggaagacgaggaggagcaagtgacatcttatgtggatggtggcaggaaaagagagcttgtgcagggaaactccttcctataatacgatcagatcttgtgagacttactcactaacatgagaacagcatgggaaagacctgcccccaggccaggtgccatggctcacgcctgtaatcccagcactttgggaagccaatgtggccagatcacctgaggtcaggagtttgagaccaacctgaccaacatggtgaaaccccgtttctactaaaaatacaaaaaattagctaggcatggtggtgggtgcctgtaatcccagctactcaggaggctgaggcagaagaatctcttgaacccaagagggggaagttgcagtgagctgagattgcaccactgcactccagcctgggtaacaagagcaaaactccatctaaaaaaaaaaaaagacctactcccaggattcattacctcccactgggtccctcccacaacacacaggaattcaagatgagatttgggtgcggacacagccaaaccatatcagatggtacgtctcttccaacattagattagactctgggacttccacctctctcttctctctctctctttctctttctgtgtgtgtgtttctgtgtgtctctgtgtgtgtgtgtctagctttctctctcagatcacatgctgtaggggaagtcagctcccagccatgtcttgagtagcctctggagcaaagaaatcgtgacccacagccatgttcctgggccatcctggacaagaatccttcagcgtcagccaagtgtcagatgccataaccccatggtaacctcctgagagaccctgagccagaaactccaactaagccactcccagactcctgaacctcaaactgtgcaagataataatgtttattgttgtgagctgctaagttttgggctaaattgtgacacagcgattgttagttcacacagatgttgatacctttgataactggaagtggggtgctgctatgacaacacttcatgtgtgatagtgactttggaactgtggctttggattatcgagagtgttagtgaaagccttgatttacccgaaaaaacctgttgataaaagattcacgtcttttgtttttgttttgttttttagagacagggcctcacgctgttgctcaggctgcggtggcatggtcatagctctttgcagcttcaaactcctgagctcaagggatcctcctgagtcagcctcccaaagtgctggattacaggcacatgccaccacactgggcctaagactcggatctttaaagattgcaagtgagcacttgtaggaaagtgaggtcaatgaactagaacctggaggaagggggtccttgttatgcagtggcagacagtttggcaatgctgttgactgcagttatgtagacagaagcaaattagctgggtaatctggccaaggagatcttcaattggtgtttaaagtactacctagttttttctaattccttctagtaagatgctagaagataggtcaacaaaaggaaagacagttaaatataaatgaattagaactggatagttctggaaattctcagtctgcctagatggcaaatgtattaggccgttcttgcactgctatagagaaatacccgggccaggtgtggtagctcacacctgtaatctcagcactttgagaggatcacaaacaaaacaggaggatcacttgagcccaggagtttaagatcagcctgggcaaggtagtgagactccgtctctacaaaaaagtgaaaaaattagccgggtgtggtggtgcatgcctgtagtcccagctacttggaagactgaggtgggaggattgcttgagcaaaggagttcaaggccacagtgagccaagatcacaccactgcactgcagcaatagtcaggctctgtcgctcaagatggagtgcagtggcataatcttggctcactgcagcctcaacctcccaggctcaagtaatcctcccattttagcctcccgaggagctgggaatacaggtgcgaccaccacactcagctatttttaaaatttccttgtagagagagggtttcaccatgttgcccaggctggtctcgaactcctgggctcaagctatctgcctgccttgacctatcgaagtgttgggaccacaggacctggccgtcagacacttacacaagcagatctcgtgggaactcagaacaagatctcacttatcagcaagaggatgactcaagccatccatgagcttcagttttgaatcacccccatgatccaaactcttccctcctaccaggccccacctcaaacactgaggattatatttcaacatgagatttgggtggggacaaatatccaaactatattagcaaattatgaaacaattaagaaatggcttctaagcaaagatcaaatgcaggtcctgccagaaaaactgtggtccaagatgaacccttaggtgtgactgtaagattccaaagagatataaggtggcatctcagagtaccactgagtcagacaaagggcctgctctatagagtaaaggtgcaccccacagcctctctcaatcaaaggagagtgcttctaggaagcttaggggctttgtccctcagctgtctgcagaagccaaaggtagagaacagatttgtgggtgttgcatttgtctatggagtgaaccccaataaaattcacagaaaatccatagtttaagagaattgtatatacggaaatgttaccagcttggactgaaaggaacagaaataatacaacctaaaaagaagaccttatttgttacttattttggggggaggggacagggtcttgctctgtcaatcaggctggagtgcagtggcacgatcttggctcactgcagcctggacctcctgggctaaaacaatcctcccacctcagcctccccagtagctgggactactggcacatgtcatcatacctaattagccatgtcataatggctaattttgtttttattttttgtagcaatgagggtttcactatgttgcccaggctggtctcgaactcctgggctgaagttatccttccaccccagcctcccaaagtgctgggattacaggaatgagctacaatgactggccaaaaagaagaccctaaaaattctactgtcaagcagtggactgaggctgctcctcagccacacacgacaccttttttttctccctttgtgaacaggggcgtctggagtagttattctgtgttctcttacatgttcaattggggagggagaggcagaggtagacagacaacctatcaagaagaattataatgtagaaactgtatttaaggaaataaagtcccacctggacttgatttagatgatctggagatggaactgatgctacaataggataagcctttggggaactttggaaggagttgatggtattttgcatgtgggaaggatgtgaagctttggagaccagaaggtggactgtggctgtctgctggctggcctgtactgattctcacctctagcagtcatacccttcagtagtccccaaccccgctgtgcctcatcgcaccatagttggtctgtgagaccaatgacatgcaacagaagtaatgtgctatggtttgaatgtttgtccctgccaaagctcacgttgaaatttaatcctaaatgtggcagtgctgagaggtggggcctttaggaggtgattgggtcatgagggcaaaatggatcaatccattcatggattcatgaatttatcttgggagtgaaactggtggctttataagaagaggaagatctacctgagctagcacgctcagtctccctgccgcctgctgccctgcactccttgggactctgcaggctccgccagcaagaaggccctcgccagatgcagcccctcaactctggactgcttggccaccataactgtaagaaacaagttcttttactttgcaaattactcagttttaagtgttctgttataagctacagaaaaacggataaaacataacaggctgtcacttctgatgttaacttatttttataagtggcttcatcttggcctctattttccactcttgctccctctgtcagatcacttgctctgggaggtgccagcagccctgtgaggaggcccacgtggtgaagaactgaggctgctggccagagccagccatgagcggaggcttctttccaggatccatgtggctgggtcatcttggacacaaatcctccagccccagtgaagtttcagatgactgcagctctggccaacatcttgatggtcacttcctgagagaccctgtgccggaaccatgggctaagccacccccagattcctgaccctcaaaaactgtatgaaatactacatatgcgtgttttacatcactaagtgtattaagcatgtgtttctttttcttttcctttttttttttttttttgagatgaagtcccactctgtcacccaggctggagtgcaatagcacgatctcgcctcactgcaacctctgttccctgggtttagcaactctcccacgtcagcctcccaagtagctgggactacaggcacgcaccaccacacccagctaatttttttgtatttttagtaaaaacggggtttcaccatgttggccaagctggttttgaactcttgacctcaagtgatctgcccgcctcggcctcccaaagtgccgggattacaggcctgagccaccacgcctggcccaagcatgtgtttctgattttttcacaggtggggccttgcggaccctggaaaggctgcccttcctggggctggccagttcctactggagagagtgcctgcctttcaaatgccaaccaaccaatccagagcccctactgcaccacctccttcactgagctctcacactgttgcaggacttctccttagttcagctaaagatggagtccttatcacacaggcacgaaaattgaggcttgcagacaattgaagagtgagaaaaacggggtttattgggcaaaaagaaaaaaatgggaaagagagacttttagcaaagcaagagagtgttcttcctgcctgtgggcttcccgcctcgcagattgaattccaggttccacacaggaagaggaggggccaagctcctcccctccgcaaactgcgtgaactactatggctccgctccagtacgcaggtaggtccgaggctctgccagggagcccttcccacctggctgcctcatcagggctctcagggccactatccacctgcactaatgactctagggccaggtaccagacaactagagttggcccttatgccccggagcctgccgaaagtattcagactcaccaatcctactcctgcttatcctgccttgcccattcctattcaaaaaccacagtcaagcctcttgttcacatttgccctgctccttctgcttcttgacccaccacggtgcttcccagcgtagccacttgtggcatagtgtgtttctttttctatctttttttttttttttttgagacacagtcttgctctatggcccaggctgccaggctggagtgcagtggcccgatctcagctcactgcaacctctggctctcggattcaagcgattctcctgcctcagcctcccgagtagctgggattacaggcgcccgccaccacacccggctaatttttgtgtttttagtagagacagggtttcaccatgttggccaggctggtctcaaactcctgatctcaagtcatccacctgcctcggcctcccaaagtgctgggattacaggcgtgagccaccgcgcctggcagcttttggttcttttatctctgtagtcttttttaacctaaataacccctttggtgattttaattttaaaatatgtccacaatgctttttcccttccttccttccttccttctttccttccttccttccttccttccttccttccttccttccttccttcctttctttccttccttccttccttccttctttcttctctttccttctttcttttttctttctttcttctctctttccttctttctttcttttcatttctttctttctctctctcctctctctctttcccttcctcccttcctctctctctttctttctctcactctctcctctctctttttcccttcctcccttcctccctttctctctctctctccctctctccctctccctctcccccctctctccctctcccccctctctccctctccccccctctctccctctccccctctctctccctctctctccctctctctccttctctctccttctctctccctctttctctctctctctctctttcgtgacagggtctcactctatcgcccaggccggagttcagtggcatgtgccatgatctcagcttatggcaacctgttcctcccgggttcaaataattctcctgcctcagcctcctgagtagctgggattacaggcatgcaccaccacacctggctacctggctaatttttataattttagtagagaggggtttcacagtgttggccaggctggtgtgaaactcctggcctcaagtgatccgcctcagcttcccaaagtgctgggattacaggtgtgagccaccgcaccaggccccacaaatgctttgactctctgcattcaaaagacacagcttccccttgagtgtgggctgtacttagtgagtcacttctaataactagaatctggcaaaagtaaaagcctgtgccttccgggactaggtcataaaaagcatgtggctttccccttgatttctcttgggccaccttgtgagctgttgtttactggtgttttaagtgttggagtaacttattactcagcaatagataactgagacagtgtccatttaactcactcctttaccatatttcctgtgaaccagaaattaaatgtagaggctagattagtttcaggttaaacatttttgacaagaatatttatagactgtcttaagaactgtcacaataaatcaggaggtacatgctagatactctactattcgtggtgttaagtttgatcacttggttccattactaaatatctcataccatgtggtagagtagattattgcccagaaatcctccctggcccatccagttctcataagaggggtgtttttccgatctcactgctacttggctcagccatgggacttgctttggccaataggatattagtatacatgatgcaagttgaggcttgaagcatgctagtgtgcttgggcctgccttcctgtgtctgccattaccacgagaagggcttctcccagacagctgtcctcccctgaacctgagccccagccagagtcatcccttgaagcagcactgtccagccaagcccagtctacatcagctggcctccagatctgtgaaaataaataatgttgttttcaggcacttcattttgggttggtgtttttaggcagcacgcacagccaaacgagattgctgctacattcaccagcctgcttttctcagagaatcagcctgctggtccataggtgtgggcatgcagctgccatgtttagacagcaagatcctgcccccgagaccatggtggatcagactagggtgggcacctgatgtaagttagacctttgatttagggtgacagtaaactagctagtgtgcgggaatagtaacagataaatgcaggagccgtgggttggccatattctgctagggaagcaggtctaatatgagaagaaacaatgaagaagatgaaaattagggagggtcctgccaatgttttaggttccggctcccatccctttcagaggcccagatccaccctgaccttcagttctagcaaactccatccttaaaattgtcccttttacatttcagataatgtcacttgtcaactgaggaatgacaaggttcataaacctagaaagaagagctttcttctcataaagggctgcagcctgcagggcagccattgtgacaggctgagaagcagagcctccagccagaagccagaaacagacccttccaggggcagaagaacaagacaggaatttatgctgaatgaggtaccaaatacacacatttgataagctatgggaggagcattgaatattgatgagaagagacataggcacatgtgcagtcgagctccatgcctctccctgggacctgtgttcaaaaaatggcagggttagcacgatccgagggtggagttttcaggcctctgacatcaaaagatgagtcagaggacatgaaaatcctcactgtgcatccttcagagatctgccagaacgacttcgtggccagcagtctcttatctaactactccgcagctagtagtcctcttaagcaaggatgccggtcagttattttgtccagaccacatgagggcagggcagcattaggtggctggttgataccaggagtgaagcctctttcccaagggttggtttctgtttagacccctaggaaggaaagcctcatggtcgttatccagggcatcggggtataatgaggcgtgtccaaccttccataccatcatggtcaggaactcagttttcaaggtttctctggggtccccttggccaggagggagtctggagaccgtcagttgcttaggaggcttagaatttcacttttatttctcatactggatttctagcaacttttaaaaaattttttgagacaggttctcactgtgttacccaggctggagtgcagtggctcggtctccagtgacgcaagctccctgcaacctctgcctcccaggttcaagcgattcttatgcctcagcctctccagtagctgggattacaggcatgtgtcactatacctgactaatttttgtattttttagtagagacagggtttcaccatgttggccaggctggtctcgaactcctgacctcaagtgatccacccaccttggcctcccaaagtgctgggattacaggcatgagccaccgcgccctgcctatatttgcaatttaagattcgtaatacacatgcctgaaccaacttcatacaggtatgcccctgaccagacctatattaatttcttgtggctgtcataacaaatgaccagaagcttggtggattcaaacaacagaaacgtattctttcacagttctgaagaccgcaagtctggcagggtgtgacccctctgaagactctaggggagtgtattattctgatctcacattgctataaacaactgcctgtggctgagtgcagtggctcacacctgtaatcccagcactttgggaggcctaggtgggcggatcacttgaggtcagaagttcgagaccagcctggccaagatggtgaaaccccatctctactaaaaatacaaaaaaaaaaaaaaattagctgggtgcagtggtgcatgcctgtaatcccagctactcgggaggctgaggcaggagaatcgcttgaacccaggaggcagaggttacagtgagctgagatcatgccattgtactccagcctggacaacaagagtgaaactctgtctcaaaagaaaagaaaagaactacctgagactgggtaatttatgaagaaaagaggtttaattgactgacagttccacaggctgtagaggaagcatggctggaaggcctcaggagacctacaatcatggtggaaggggaaggggaagctggcacatcttcacctggctggagcaggagaagagagagggaagggggaggtgccacacactctaaacaaccagatcttgagaactcatgatgaggagaacagcaaaggggaagtccactcccccacccccatgatccaatcacctcccaccaggcccctcctccaacactgaggctgacaatttgacaggagatttgggtggggcacagaaccaaaccatatcaaggagaatcccttcttgcctcttctggcttctggaggatccacgtgttccttggcttttggccgcatcactccaatctctgtccccctccgtgggctgcatcatcttctgtcttttacaaggacacttcttgaatttagggcccacccagatcatccaggaagatcccatctcaagatgcttgacttaatcacatccgcaaagaccctttttcctaataagctcacattaatgaattctgggtattagggcaagcacctcatacctcaggcaggattcttgccaggcctcagtcagaataccctcaaaacttggtgcatctaccaggagcgggggctcatgcctgtaatcccaacactttgggaggctgaggcagacagatcactagagattgggagttcgagaccagcctggccaacatagtgaaaccccgtctctacaaaaaatacaaagattagctaggcatcgtggcatatgcctatcatcccagctactcaggagtttgaggcatgagaatggcttgaacctgggaggcaggttgcagtgagccaagatgttgccactgcactgcagcctgggtgacagagtgagactccgtctcaaaaaaaagaaaaaaaaattggtgcgttatatcgattccaaacatatagcattttaaatatccacaaaagttgtgtgtggtctgaaaaataagaaaaagcaagattcaaacaagttttaaattcgttcatattgaaaggaacaaggatttacatatttatggatccctattaaagtcaaaggtgtttgaattaagcaaagtgtataactgaagtgtagcaacataggccacgctaacacttcttcaggttatgggggtgggtcattgacaaagcaactgtagaaagggctctgcatgacgaatggcagtgggaagagtcattcgagatccctgcagcattgggactcccgtttgcctacagtccccgaccttagtggccttaattaaccagcatggtaactatccttttttttttcttccagaccgagtctcgctctgtcccccaggctggagtgcggtggtgtcatctcggctcactgcagcctccacctcccaggttcaagtgattctcctgcctcagcctctggagcagctggggttacaggtgtgcaccaccacaccaggctaatttttgtatttttagtagagatggggttttgccatgtgggccagactggtctcaaaactcgtgacctcagatgatccacccaccatggcctcccaaaatgctgggattaccagtatcatgaaatgcaggtgagccaccgcacccagccatctctctttttactactcagcaaccttggcacacgccaccatgcctgaagaattgttttaagtcattttttgcagagatgggtggggtctagctatgtttcccaggctggtttccaagtcttggcctccagtgatccttccacctcagcctcccaaagtgctgggattacaggcatgaaccaccataaccagacaggtatgtatcttttggttggagaagatttataattaagtactgaaaacttgtgagactcaaaaccataccatagtattaatatgaaatttgtttaaatagggatatgtgcatttttggtattttatgttcttaatatagttaagggaatttggcctgttagaaaggtcagacatgtaacataaagttaaaaggtatgagtaaatagttaatttagacttgtgatttaaggatgaagtctcattttatttaccatattgaaatgctcaggagagaatttgtttttcttcctttgcaaatttaatgtattagatttcctataattatttagtattcgggaatttttgttgttaattcagacagcaaaagtactctaaaaggaaatcagttacattaaatttataaatgttgttgaaaaggtttgaagatggttaattaactaagttaggctgggcgcagtggctcacacttatcatcctagcaagttgggaggctaaggcgggcagatcgcttgagttcaggagttggagaccagtctgggcaacatggtgaaaccccatctctacagaaaataaaaaaattagccagacatggtggtgagtgcctgtagtcccagctacttagggggctgaggtgaaaggatcactcgagcccaggaggttgaggctgcagtgagccaagatcacaccactgactccagcctgggtgacaaagtgagaccttgtctcaaaaaaaaaaaaaaatcttttcttttttaattaactaagttagtaaataagaccaagtaatatccaaagacctcttaaaacagattcctgagtatcctagatgtataagaaaaatgagatctataacctaaactttaatgactaatgaaagaatacacatttaggatttgtacatttaatatgttgaaaatcaaaacataaagccaaaatgaacatctgcatagttcctctgtacctacaagctaccctcaaggataccaaaaacctcgttttaacaaatccatgccatcccttgtccatttctggctgccaatgtattgaatgctttttaaggtccaactacaatgcaccaagttaaaatgtttttttaattcctacctttctgtaattcagatcacatgttacactgccctgctctaaaccaccattttacttgatttaaaactattatgtgaactctaagtgctttgcttgagttgtcatggtttgtgaaatgtgttaagtcatggtagttaagcggcagagctctgagctctggagcagactgcttgcgtgcaaatcagagctctgctgctgtgcttaactctccatgcctctttgctcatctgtaaaagggggtagaaattgtgtctactgcacacaaactattttaaggattaaactgtatgactaacagattaaattgtatgttaagtgcttagaacaatgcctggtacttggtaaacattcaatcaataaataagatactatcatgtttgtgaacttcagtgttcctaaactgtaccatgacattgcaagctcattgtgcaaagagatcagtcttactgagttgaatatagaggcgggatttctcagtctctgcagcaaggtggctgggttcaaagaaatggattctggatccaatgcttattcaaacagcagccttggtgagctgactagaaaaacaatccccttagtcatcaattaatttttctatctacaaagcaagatgacaaagggcagcaatgtggaggaaggtatctcttatctctgttccaaacgagagctttcctaaaatttgatggacagtgtgatgggtaatattatgtatcactttggctaggctatggtgtccagtagtttggtcaaacacgagtctggttgttgctgtgaagttaatttgtagatgtgattaacatttaaatcagttgactttaaataaaggagatttttacccttgataacgtaggtgaccctcatccaatcagttggcctcaagagcgaagcctgaggcttcactgagaataaggaattctgcttcaagactgtaatatagaaatcctgcctgagttttcagcctgccaacctgccctacagatttcagacttgccaagttccatagttgcataagccagttccttaaaataaatctctatctatgttagtctgctagggctaccatacaaagtaccacaaactgggtggcttaaacaacagaattttattctttcacagttctggaggccagaagtccaagatcaaggtgctggcagggctggtgtctgttgaggcctttcttcttgacttgcagatacttgcttctcgctgtgtcctcacatggcctttcttctgtgtacctgcagagcaagagatctcttggtgcctcttcctcttcttacaaggaccgcagtcctgttgggttagagccccacccttaggatttcatttactcttaatcacgcccctcagggccctatctccaaatacaaacacactggggttagggcttcaacctatgaatttggggaggacacagtccagggcggaactctatccatctgtctgtctgtctgtctgtgtctatctccctatctgtctgtctgtctctgtctgtcatctatctatgtatcttctgtctgtctgtctttctatacatgtatctatctatccatccatcctatttgttctgtttctctgaaggcccttaattgacacagcagaatgaaatatgacacttcatcatatacagtcattcagctgactccagtgctggcctttataatccatccaacctattggttgtttaatgtaagcggttacacctagattttcttttttttttttttttttgagacagagtcttgttctattgcccaggctggagtgcagtggcatggtctcagctcactgcaacctccacctcccagattcaagcaattctcctgcctcagtttcccgagtagctgggattacaggtgcatgccaccacacccagctaattttttgtattttttagtagagacggggtttcaccatgttgcccaggctggtctcgaattcttgagctcaggcaatccacccgccttggcctcccaaagtgctaggattacaggcgtgagccattgcacctggcctggttgcacctagattttctaaaaataaaagcttaactcctcccctgaaactacttgagtacttttttttttttttgagacggagtcttgctctgtcgcccaagctggagtgcagtggcgtgatctaggctcactgcaagctctacctcctgggttcacgccattctcctccctcagcctcccaagtagctgggactacaggcgcccgccaccacgcccagctaatttttttgtgtttttagcagagacagggtttcaccgtgttagccaggatggtctcgatctcctgacctcatgatccacccacctcggcctcccgaagtgctgggattacaggcatgagccaacacacctggcctttttttttttgtttgagacagagtctcgctctgtcacccaggctggagtgcagtggtacaatctcggctcactgcaacctccgcctcccaggttcaactgatcctcccacctcagcctcctgagtagctgggtctacaggcacacccaccacgcccagctaatttttgtatttttagtagagatagggtttcgccatgttggccaggctggtctcgaactcctgacctcaggtgatccacccacctcagcctcccagagtgctgggattacaggtatgaaccaccgtgcccggctcttgagtaaattcttgaaataaaaagtaaagtatcataaactactgtttaatatttctgctgacaaagtagctttgaaatcaacagcgttacaggtttttgtttatttgttgtttgtgagacagggtcttgctctgttgtacaggcgggagtgcagtggtgtgagcatggctcactgcatccttgagctcctgggctcaatgtgcctgtgccgggccttgcattactgttgttgttgttgttcctaattgccaggcctgtgaatattgcattacagttctatgaattaaaatgaagaggccaggcgcagtggctcaggcctgtaatcctagcactttgggaggctgaggcaggtggattgcctgagcttaggagttcaaaaccagcctgggcaacatggtgaaactccatctctactaaaaatacaaaaaattagctgggtgtggtggcacgcacctgtaatcccacctactcagaggctgaggcaggagaatcgcttgaacctgggaggcggaggttgcagtgagccgagattgtgccactgcactccagcctgggcgacagagcgaaattctgtccccaaaaaataaaaaaatgaaaaaataaaattttaaaaataaaaataaaatgaagacatgtttatagcagctctatttgtaattgcccctaactggaaacaactcagacatctctcagtgaacgaatggataaacaaatcttagtaacccatataatgaaatactactcagattttctttcttttttttttctttttttcttttttttttttttttgagacggagtcttgctctgttgcccaggctggagtgtagtggtgcgatctcggctcactgcaacctctgccctctgagttcaagcaattctcctgcctcatcctcccaagtaactgggattacagacgccggccaccgtgcccggctaatttttttttttcttgtatttttagtagagacagggtttcaccatcttggccaggctgatcttgaactcctgatctcgtgatccacccgcctcggcctcccaaagtgctgggattacaggcatgagccaccgcgcctggcctactcagatatttttttaaaagtattcatacatcttaaaacatgaatgaataagtgaaagaggtcagtctcaaaaggttaccacctacctgactccattgatacgtcactctgaaaggtgaccctgcaggaagggaaacctggtgattgtgaatggctgaggtcgggggtgggtttgacagcaaaaacgtacttgagggggttttctgagggaaggaaattgctctgtgtcctgattttggtggtggatacatatatctgtactatctatacacctgttaaactcacagaactgtacaccaaacttgaaagtcaattttggctgggcacaatggctcacacctgtaatccaaaactttggaggccaaagcaggaggattgcttgagccttggagtttgagatcagcctgggcaacatagtgagaccattttatagtatgcaaattaaaataatgtaaaatgcagaaatagacaaatattatataacatagacaataatttcttttcttttctttcctttttttaatttttgagacagggtctcgctctcctgcccaggctggaatgcaatggcacaatcactgctcacttgcagcctccatctcccagacctaagctctccttctacctcagcctcctgagtagatgggaccagaggcatgtgccactgtgcccggctgatttttgtatttttttggcgagacagggtctccctatgttgcccaggctgagctggggctcctgggctcaagcgatccttctgtttcggcctcccaaagtgttgggattacaggtgtgaacccaccacgtttgacaataatttcttgttcttttttctccaggtatttgctgctcagaattggcaaatagaggaataaactctgttaccaaattccttaatttcaggagaacccatgaaaggagtatcatccaatcaggtgggttttttccactaaaacaacagagaagttcttcctgaaatcataacctgggggcataagttttaattcaaattcttgcaagtgatgtcatgatgtcagggtgagaccacagagtacagggaaaccgcatccttttggaaacagcaatgtctactagtgcagagagagctgctttgaagaaagggcagaaagggagagcacgatttcactaatgcaaacggcagtgaagtgcaaaggagggcagcctccggctccttccagttgggagcgagcaaagcactggaaagggcaaaatgaggcacaatcaccatcatcaaacccctttatcaagttctttttttttttttaaggccgggtctcactcttgttgcctaggctggagtacagtggtgcgatctcagctcactgcaatctccacctcctgggttcaagtgattctcctgcctcagcctcccaagtagctgggattacaggcatgtgccaccatgctcagctaatttcgtatttttagtagagatgggttttcaccatgttggtcaggctggcctcaaactcctgacttctggcatgagccactgtgcccagcatcaagttctttttcttttctccctgactagctcttagtctcaatgatcaaactcctcaggcatgttaagtgggtaaagagtattttattttggcatttgaatctaaaatcataggctttcttgaacaaccttgctttcttatttcaaaggtgaaaccctactctactgttccggaaagtttggaaatgtctcatttctttttagagatgaggtctatttttataggaaaatgaatccatcctgtcaccttttaggatactatttgcattaattatgtactgctgcagaacaaatgtccctaaaacttagtagcttaaaacaacaatgtattgttcctcacgattctgctggtctcatctgggctcactgagactggagggtctagatgacttcattcctatgtctggggccttggtacagctgccggctggacttttcatccgtggaccctgggtgttccaagtgattaaaaatggaatttacaatacttcttaaggcctattctcagaggcttcacaatgtcacttctgctgcattttattggttacaacaagtctcaaggccagctcagagtcaagggatagagaaataggtcccacctcttgatttcgggagaagcagcaaagtcacattgcaaaggagtgaggacacagggacactattcactaggggccatggctgtaacagtctaccatacaattgttagtgatgtttaaagtggatataaacattgattaaattgctcttggctctgaaccattagtaaactggatgaaattcggctaaagatgaattttggattggaagcccacattcagctcagctttaatgtagttaacccttatttcaaaactatgagaaattacttatagatgagtcagagaaccttgaccccctgtttttttatggggattttaactatcaacttagagaaaagtaatgtgggatccattagctattttaaatgcactattattctctaattgtaggtcaactctctttggtttcctaatgtctaaacatttcacaatttatggaattatgaaaggatccagctccccagaggatgtgagcacatctgaacacaattatgcactgcagccagacaactgttagctttctggggcaaaagacacagagaaagaccaggataatccttgtgcgtgcagctcagatttggcccctgtcgccacacgctgccaagcctgtcacattctggcaataaggagcaatgcttggatggggaccaggaccatgctgacatctgaccacctctgcagtctgggcgaattccaagaaatccctcagaagaaagtgccatgcagaaatatcctggcgggggaactgcccacacagctgtgccagttattcaccctcgccagattcttcatgctctttcccacttcaaggcccttgcattagctgttctccctgaccatgcacttgactctcaagaacatttaggtaagtcatgtccttacctaagcttaggggcttaagcgagggacttggtgtcctggaagtactccctagctcgccactctatgtagcacccagtccagatcttcagcctccatccatcctttgagaatgttttatcctctgatcccttgagatatgggccctttctgtgacccaccagcctgtgccagagcccagggccttaattctggaggagacatgatgctaccctgggaacaggtccttccgggacacgaggcagctggagagctctgggtgtgacagaggaatacggaaacagggagaagaaacaaagaaacagagaaatgaggaaacgaggaaggaaaagggtggctcctggagacaaatgtttccttctccacacttctgctgatgctgaggtggcctttaaagtgccagcaaggaggagccgggaggggtttgcacatgtgttgctgggcatggatggggtggtgtgtgtgccaggatgggagccttcctgggcagtcactactgggtggggcgctccagtcaagacatcaagacagacagctaaggctttctcccaaaccaaaagacttgcaaacttccctacaagttctgagttttcttctgaagctaacttcttggaactcaatggcatgaaaccgtcatgcagttaaagcatttaagggctgtatatgccctgggggctgtcaatgtcatagacactgtcatttctctctccctgcacaaaaataactaaaatgatgaatccggctggctctcccctctccctcgctatcctccaccttttatgcagtcctgcggacattctgatctgtttcctcctccccatcctccccttccctcccaagtatactctcagctcttcgtggtctctctctcccaactgcagcctcccccaagactccatcttcaggcctccttccctcaccatctccaaggctgcggctccaggacacaagctgaccaccctgcccaacccgaagtcctcgactgatgctcagcgcttataggttcaagtccaggctccctagcatagcactgaagtcatggctcagtttacccttccaagcctgtctcccccaagtcctgccctcctcctctcatcactgccaagtacatcaagcactcccacgtggctgggctttaacccaagctgctctctcttcccagaaggctcttctctgacttgctgccaaaacacaaagtcgcttggaggtgaaggcaaatattagttcagctggcaagctcctctccacgtcctcatcaaagcccccagctccatgagcttctgggctgttcctgtggatttctgcactctctgtgttgaaacatctgtaatgggttatagctgggagttggaatgtctgcctcccttttcgctgagaagaagggggtctttacaggatcgaacgctccctgggttctgtctccttcctttcaatatagtgagcagttcctcccacctagtgggttctccttagatgtctgggaggtcatctatccagtgctggctgttgcagatctgtgcagttgctttttgaacaggacccacatccgtcttccaaaatatctaaaattaggtctttgacagttcctgaaaatgttagttatcatataatccagcaactccactccaaggtatatagccaaaagaattgaaatcatattccacacaaaaatgtatacctgaatgctcatagcagcattattcacaatagccaagaaatggaaaccacccaaatgtccatcaacccacaaaggcataagtgaactgtgatatacccatacgacagaataccgtttggctataaaaggagggaccgattcgtgctacaatgcggatgggccttgaaaacatgctaagtgcaagacgccagttacaaaagatcacatattatgtgatttcattcatgtgaaatgtccagaaatagtcaaatttatagagaaagaaagcagattagtggtcgccaggagctggggcaaaggagggcgtgagcgtgattgtgaataggtatggctttttagagaggaaagggggttgtggtcatggtcgcacagcatgtgactcatggagtttgtgcccttgagaggagggactgctgtggcatgtgagttacatataattaggccttcagtgctgccagcattctcatccttggagggccaggtatcttttctgttgttttgttttgttttgttttatgagatggagtctcactgtcacccaggctggagtgcaatggtgagatctccgctcactgcaatctccatctcccaggttcatgcgattctcctgcctcagcctcccaagtagctgggaccacaggcacctgccaccacgcccagctattttttttttttttttggtatttttagtacagacggggtttcaccatgttggccagggtggtctcgatttcccgacctcgtgatctgcccgcctcagcctcccaaagtgctgggcttacaggcgttagccaccgcgccccaccgtatcttttcggttctaagcacaagacaattgtcttgggaacacctcccggctcttggcctcagtatgttttctttagccctacgtttcccctttgctctctccccgcgtgtgatgggggctgcctgggtggggctgtcacagcggcaggtgggtgaggagcccctaggcgcgtccggaggaaggctcacccggaggccgcctgcaggcggccaggtgccagccactgcgggcctctggggccgaagccggcggatggtgagacgctggttggtctgcaacactgcccagaccccgggcactcatgtctagaaaaaagctgactcgtgacaccaaaggagctctttcaagcttcctgcacgctcttagcgccagagcaccccagccgtcctgggagcccccgaagccaagcatattcgaactccgaatccgctcgatcgccggggacctgccatctgggttcggttccccaaggtcgctgccgaccttagaccgcgggggtgtggggcgccggggaaggagacagaaggacaggcgccgcccagggccgcggggacacttggggctgcgtcctgggtgggcgcgatgctcccccagaacgactggagatggagagtgtcggggagggaaacgggacccacgaattcagggcgctgagtcggcggaatgcgccctgactccccctggccgagagccggctcagaatgaaagagcgcggagtgggaggtctgggaaatggcagtatttgtattagggagagaaggaaacaggagtgggagccgcacggcttggggaacgcgggagatcgcggattgcggggatagcgcagcgcggctgcccggggctgctgggaggggccggacgaggccagggcgagcggggtaactgcggccggccggacggcggcggtaaccggctgcaccgaggtggttccaccaccgcgctgggcgcttgcggttcgtctgctccaacgaaagccgcgtcccacgctccctgccgccgcgtggttttgcctcctcagaggggcagcggcgacccaggggctggcggtggatgtcaggagtgcgctttccttctaggccttctccctcatgactggttttgtttttagattacaaaaataacttatattatttaattaaaaatacataaaatatattgtgatagcgcagaataatggccctccaagaatgtccacggcctaatgtctagaaactgttatatggcaaaataaatacataaataaggtggaaggcctttgcagatgtgatcaagctaaggatttttttatttttatttgatattgattgattgattgattgagacagtcttcctctgtctcccaggctgaagtgcagtggcgcgatcccggctcactgtaacctccgcctcctgggttcaagcgattttcctgcctcagcctcccgagtagctgggattacaggctcctgccatcacgcctggctaattctcgtattttagtagagacaggggtttcaccatgttgaccaggctgatctcgaattcctgacctcaagtgatccgtctgccttggcttcccaaagtgctgggatgacagatgtgagccacagcgcctggcaaactaaggatttttagaccggggattaccctggattatccaggtggatacaatgtccagtgatcacaggggtcctagaagagggaggcaggggaggcagaggagaagtgagggcagaaggagaggtcagagggatgtgtttgcttcgaggatcaaagaaggggagcaccggccaagggatgcgggcagcttctagaaggtgggaaaggcaaggatatggattctccctgagcctccagaaggaacccagttctgcagacactttgatgttagcccagtgtgaccctatgcatacttctgacctccagaactgtgcaagaataatctgtgttgttttaggcccctcaatctgtggcgatttgttataggagtcctaggaaatacctgaacacaaacatttaaaacataaagaagtcacctgtaatccacttcccagaatgaactcattcagcagcctgaggagcagggctgactgatgaaaacacttgaaaggaggaagtgccgtcttgctaaggctggtgtgttcagaagaggacaccgtgaatgattctcctgactaagatggtccactaaaaggaaccagggctccgtggagaaatggcgacttctgggattaaggctggagaggaataagatgaacccagaatatattattctggcagacagtgaggaagtacccagagaatggtaggaactcatccaaaggacaaaagcttgaaggggctctcattgggcaaatctggaatcttttgagtaacaatcatgttagtattgaattgtaactcttttttttttctttttgtagctgggattacagatgcctgccactatgcctggctgatttttgtatttttaatagagatggggttttgccatgtcggccaggctggtcttgaactcctggtctcaagtgattggctcacctcggcttcccaaagtgctgagattaccggtgtgagctaccacacccggcctataactcttcttactttattataagcacagtctaagaatccactagtacctacaggtacagtaatataaatgaaaaagtaaagagggagaagaaaactctttcttatcaactaataaacgcagaaagataatggaataagaaaataccgcttggaactaccatagtaatgattatgtcagggagaatcatcagtgaatgctaaattgtgagaaaagtttgagaaacaggatttgtatatggtctcaaactatcgctgcacgagggagattcccagtaatgaccgaggggaaaacagtcactttactgtggggaaacctgacaaaccttattcaagcgatcaaagttaacatcaccagcaatgggacaaataggcaacacgtgcctctggtgtgctgcagcaggcctccatgatgcaatagcccttcatggtgctcgtgctggccgtgcagaacctgcattcaattgtgaggaaataccaacacatcaaacagagggacattttctaaaacactggcttctgccctacaaaaatgtcaatgtcatttttgacaaagactgaggaactgtttcttactgaagaggactaaagaggcctgacaactaagtgcagtgtggattctgaatagtgggccagatgaaaaatgtttgtttgtttgttggtttgttttaattataaaggaagtgaatcatactaaggcatagatgaaccttgaggacactgtgtgcgatgaaataatccagacacgccaggcgcggtggctcgtgcctgtaatcacagacagcactttcggaggctgaggcaggcagattgcttgagctcaggagttccagaccagtttgggaaacatggtgaaatcccacctatgcaaaaattagctgggcatggtgtcccaagcttgcagtcccagctacttaggggaggtggaggccgcagtgagctgtgatcaggcctctgcactccagcctgggtgacaaagagagaccctttctcaaaaaaaaaaaaaaagtccaggcacggtggctcatgcttgtaatcccagcactttgataggccgaggcgggtggatcgcctgaggtcaggagttctagaccagcctggccaacatggtgaaaccccgtctctactaaaaatataaaaattagccgggattggtggtgggcacctgtaatctcagctacttgggaggctgaggcatgagaatcacttgaacccaggagacggacgttgcagtgagccaagatcacaccactgcactccagcctgggcgacaaagtgagactctgtctcaaaaagaaaaacaaaacaaaacaaaaagtagaaaaaaagagaaataatccagtcacaaaatgacaaattatcgtgtcattccacttatatgaagtaccaagaatagtcaaatttatagagacaaaaagtagatggagggttaccaggagcttggaggaggggaaatggggacttcgtgtttaatgtgttcagagtttccgtttggggtaacgggagatggataattgtgatggctgcatagcactgtgaatgtaatcaatgccataagttgtacttttaatggttaaagtggtaaatcttacacatattttactataataaaaataatttctgaaaaaaagtcttcaactttcaaataaatgggtagacaattgacaacatttacataaggtctgtagattatataataatggtatgtcaagattaatttcctcatcctgataaatgtactgtggttatgtaagaaaatgtcagctggtccaaaggtagtgagttatctcaattgattgttcccagacagttacagatcaaactccttctactctttccccgcttctcaccactgcacttgactagttttaagataaataaaatgtctgtgtgtgtgtgtctgtgtgtatgtatgtgtaagaaatatacattggggccgggcatggtggcttacgcctataatcccaacagtttggaaggccaaggcgggtgaatcacctgaggtcaggagttcgagaccagcctggccaacatggtgaaaccccgtctctactaaaaatgcaaaaattagctgggtgtggtggcgcatgcctataaccccagctactctggaggctgaggcacgagaatcgcttgaacctgggaggcggcggctgcagtgagccaagatcacaccactgcactccagcctgggtgacagagcaagactttgtctcaaaaaaaaaaaaaaaaagaaatatacattgaggtatttagggacaacaaggcatcatgtctacaatcccctaaatggttagaaaaagtaatatatacaagttatacctgtatgggcagagagaaagagaagggtaaagcaaatgtggcaaaatgttaacatttggggaatgtgggaaatgtatatgggaatttgtactattattccaacttttctataagcttaaaagtaagcagtttaaaaaattagaagaggatcaaccaactggaatggggcatgctctagaggaaacaattctaaggccttaacatcgagatgcagtgagctgtgtgggcagccagggctctgggatgtcctaatgaggcaggctcaggaacaaaggatgcagcgtcccagccacactgactggtggggcagagagaggtgaggaacgttggatcagatgccccatccacttacagagatgggccaggatccaaggaggcatggtgagctgggtttggttcagatgggcatccatccaaggagtttcaacgggaaggtgtgatggttaatactgagtgtcaacttgattggattgaaggatgcaatattgatcctgggtgtgtctgtgaaggtgttgcccaaggagattaacatttgagtcagtgaactgggaaaggtagacccacctttaatggggtaggcaacatctaatcagccgccagcgaatataaagcaggcagaaaaacgtgaagaggtgagaccggcctagcctcccagcctacatctttctcccctgctggacacttcctgccctcaaacatcagactccaagttcttcagttttgggactcggactgactctccttgttcctcagcttgcagacagcctactgtgggaccttgtgatcgtgtaagttattacttaataaactcccctttacatatatataaaaaatatatatatgtatttcctattagttctgtccctctaagagaactctgaccagtacagaaggtgaggtggaaaagccaggagaccagtcctgttgctgggggtggaggaaagcatgctcagcagcaccacccccatcctccgactgcacacccaacacgggagcatctcatcaacacagtgatgagtgaagtaagctggacacaaaaggtccttaccataggattctattcatgtgaagctcacatacaggcaaaccaaacagatggtgatgaaggtcatatccatgtccacaggggagtggatattagctgggaagggcaggagggaagttggtgggtcctggaaatgttctatatcttgatctggatgttggtttcagtttattaagatgagcacttacgctttgtgcatatttttctgtatgtgtaaatcctccatttaaaaaggttcggatcgccccacccccaccttggcacagagcactgaaatcacggtcatctaagtgaggcattcacggagattcaatggagacacgatttacgctgttggttatttcattgctaagcaacgcagtctaagctgcacaactaagtgacaccattaacagccagcatggtggggaggggtgggtgtgctaagacaaggatcccagcgtgatggccatggatgattcctgctcccagcccccattttgctgttggaggtgggggctgggggttgggggggcagcgagcagcacagaccaaacagaaggcctggcccctcctggcgtgggctggctgcagtgagcccttcctatgtctgcctgctgcatccatcgctatggcaaccacttccccagcaccggggctaaaatcaggttctgtgggtgtctcggcagtgattggagatctcccctgccatagaattgagtggcctgatgaggagacaaagaagtcactgcagggaaaggccgagactcgctaagcagggccattcctgccaaagttgcacagatttgaggctggcgcacaggcctcagagagagtggtgaaggctgtctgaaggcaggggtgggcaggatgccaaaagaaagacctaaggactggttaaaacgaaaacgatgtggagataaacaaagaccacccaatgagaacaagcaaaggctattcagggcttgctgtagaaaaggaggcggctgccattcctagtgcttggcagagacttgaaggcaggcagaggagtggaaagcttcatagtggaggaggagaggctccaggtgtgccctgagtgaaggctgctggcctggggaagcctcaggtggctcaccagaagcgaggcatccaatgcgactggttaggggagcatgttgggctttctctggtcctaagttggaagcagcaggaaaaagtagggaagccagtggttattgatgatgtcctgactgttctgggcagattgctgtggacgttgtggtttggcttcctggactggctgctgcagattgtgggtcacacttctgctgtcatctatgggctggctgctgtctgtatattctgtctctctatgcagcagttgggcaggtcaagaaagaggtccctaccatctatcaatgaggagatggggccctttgcagtgtagggacacagctgtgagggctaccccaggagaagcaggacatgaagcctcacaggaaggaaggcataacaatgcccttttctgtttggggaatacagacaagaagaaaggtctatacatgtttagtacagatgaaccagtccttgatccacagttggttgaagtcgtggatgcagaacccatgagtacagaggcacaactatatatttaaagagacttatctgttagagagctactcatctgggccttagggagctgacctgatacccattgtaaccacacgcagcacaggagtttgaaactctaggcaagggaggtaagtgaggttaaatatctggctgaactcagaaatctccaaggagccccacatgcttttgtgacacaggccctggggccatttctcaactgcagccactcaggaggtgtgaggcctgggcaactctgcacctgagtgttctccgcctccgccctggcctccttggttggatggtgcttgcattcagcaagtgctccgtccatgctagatactgtaattattttcgagcttctgaataaccggttacaatttcaattaaaaatatttttagaatcaatgtcagtctctgttggtgcagccatgaactaaatgtcagaagcctggactcagagtcggggagggaagtggatggaagggccagcagtagaaacacagcacctgtgggtaccaggggagggtacatgtagtcctgcctcggctatccgccctcccctgactggccgatttcccctagaactctgtgttttgagtgagggaggcgcagttctctaaaagaaaggaagatattattgccaggagaagaaggaaggagaacttaacagacaaacataacatgcacatgcattcaacgtttgtggtcaaatagaagacttaagcctaagggatctagaaattctagttagatcccgaagttacatctaagcagtcataatggtgatcattatgtggcttctccaactgatgttgtaaaaatgattctctcccagtaaagctaggcagtagttcttaatctaactgtagccttcgccttctttgaggacagaaatcaggccttagacttgcctaatctgcttgttttggggatctttcatagtgtattatacagaataatatactcaaatgatgtttgatgataattgtcttgtttcagttcaggctgctatttcagaatatcatagactgagtggcctaaatcctataagaacactcactaatcccatcatggggaccttgtcttcacgacctcatctaaacccaattatctcccaaaggcctcacctcctagtaccagcacattggggattaagattttaacatatgaattttggggggacataaacattcagtccataaaacaataaagacacacgagaagctaacaagagatattcagcgtcagagctcaatggtttccatgaataatggagtgagatataccagataattcctcaaggttctttggattccatgtgtctaagataaaaactcttaggaagagtttcactttggagcaaatatacaatttcaggttagaagtcaaaatatcagatgaaaatgtatgatctctccacaatatctgtgggggattggtttccagaccctgcacccaaaatccatgggtgatcaagttccttatataaaatggtatagaatttgcatgtaacctatacatatcctcctttaaatcatgtctagattacttataatgcctaatacaatgtaaatgttatgtaagttggcgtactatatatctacgtttgtttgtttgagacagggtctcactctgtcgtcccggctggagggctgtggcgcgatcacagctcactgcaacctcgacctcctgggctcaagtgaacctcccacttcagcctcctgagtagccaagactacaggcacacgccaccatgcctggctaaaaaaatttttttggtagagatggggtctatgttgcttaggctggtctcaaactcccgggctcaagcaatcctcctgcctcagcctcccaaagtgctgtgattacaggtgtgagccaccatgcttggcttgtcatactatttcatttagggaatacagacaagaagaaaagtctatacatgtttagtacagatgaacctattcttgatccacaattggttgaatccatggatgcagaacccaagaacagggagggcccgctgtagatttatttatttatttacatagttttgagacagagtctcactctgttgcccaggctggagtgtagtggcacgatgttggctcactgcagcctctgcctctcaggttcaagtgattctcccacctcagcctctcgagtagctgggattacaggtgtgcgccaccatgcccggctaatttttgtatttttttagtagagatgggtttcactatgttggcaaggctggtcttgaactcctgggttccagtgatcctccctcctcaacctccaaaagtgctaggattagaggtgtgagccaccgcacccagccccaactgtatatttaaagagactcatcagttagagagagactcaactgcatcctagggagctgacctaagaatcactgtagccatatgcagcacaggaacctgaaactctaggctcagctgcagccttttcagtgatgaagtcaatgcttaagtctagactagtaatgaataaggtagctgtaagtaagaatagttcatcacccactgctgggtttgcatcctcctccaaataggccctccttatttgcttcctgtggctgctgtagcaaattatcacaaactgggaggcttaaaacaacagaaatttattccctcccagtactggagttgagaagtctgaaatcaaggtgttggcagggccacatttcctgccgaggctctgagaatccattccttgtgtccttcagcttctggtggctgccagcattccttggcctgaagctgcatcattccagtttttgcttgaacccaggaggcaaaggttgcagtgagccgagattatgccactgcactaagaaaaaaaaaagaaaagaattggagattgacacagacataaaaaggaggttttatcttactggaaaaattatgggagaattttgtgataaagagcttagaaggttttgtaaaataaacttatctttataaataacaagaatgtttttaatagcatgaactttcaaatttcagaataattttaaaatttggctgtcctgcttaatgactaagataagaaggaaaggatctgaggacttactccatagaatactcaataaatggtgagacttggcagccaccactttaaccaagtactcaaactcagaatgtgaatcatggcacaacctgactttctggcctccagatgtactgtaatatgaaaaacacataaccggccaggcgaggtggctcacgcctgtaatcccagcactctgggtggccaaggtgggcgaatcacttgaggtctggagttcaagaccagcctggccaacatggtgaaacccctgtctctactaaaatactaaaaatacaaaattacaaaaattagctgggtgtggtagtgtgtgcccataatcccagctgctcgggagggtgaggcaggagaatagcctgaacctgggaggtggaggttgcagtgagccaagatcacaccagtgcactccagcctaggcaacagagcgagactccatctcaaaaaaaaaaaaaaaaaaaaaagagaaaagaaaaatgcataatcatctatcaaatattcttgcaaaaacatgtttaacttgaatcagattaagcctctaagcctacctgctagtttataggaaatacaggggctaaaggaacaagctaatgacaccaagaggaatcagtcagataaatctataatgaaggacattcattgcatgaaacaattgttctatggtcttccaaaaggcattgtcattggaaaacaaaaagtactaggaccattctagactaaaggagatggactatcgagaccaaaccagtggcaataagggaaaccagattggacccttgttaaacaaacaaaattataaaggtcatgtttgggacaattagagaaactttagagtctatatattattatggtgtggaaatcattttcaaggagattattctaaccttaggagatacatgctaaagtatttaggggcaaagatgttcaaatatatatactttggcgaggctcggtggcttgtgcctgtaatcccagcactttgggaggccaaggtaggaggatcacttgacctgaaaagtttgagatcagcctagctaacatggtgaaaccccatctctactaaaagtacaaacattagctgggtgtggtggtgcacatctgtaatcccagctacttgggagactgaggcaccagaagtacttgagcccaggaggcggaggtgacagtgggctgagatcgcaccattgcactccagcctgggtgacagagtgaaactgtctaaaaacaaaacaaaactatatgtatatacatatttttggaactgtatatataatatacgtatattatatataatatatatagttcctttctgtatcattggaaatatataatatatgttatatatataacatataacatatataatatatatataaaacatataacatatataatatattatatataacatataacatatataatatattatatataacatataacatatataatatattatatataacatataacatatataatatattatatataacatataacatatataatatattatatataatatatggtatatatttccatatattatatataataaatatatattatgtataacatatataataaatatatattatgtataacatatataataaatatatattatgtataacatatataataaatatatattatgtataacatatataataaatatatattatgtataacatatataataaatatatattatgtataacatatataataaatatatattatgtataacatatataataaatatatattatgtataacatatataataaatatatattatgtataacatatataataaatatatattatgtataacatataataaatatatattatgtataacatataataaatatatattatgtataacatatataataaatatatattatgtataacatatataataaatatatattatgtataacatatataataaatatatattatgtataacatatataattaatatatattatgtataacatatataattaatatatattatgtataacatatataattaatatatattatgtataacatatataattaatatatattatgtataacatatataattaatatatattatgtataacatatataattgatatatattatgtataacatatataattgatatatattatgtataacatatataattgatatatattatgtataacatatataattaatatatataacatatattatgtataacatatataattaatatatataacatattatgtataacatatataattaatatatataacatatattatgtataacatataattaatatatataacatatattatgtataacatatataattaatatatataacatatattatgtataacatatataacatatattatgtataacatatataacatatattatgtataacatatataacatatattatgtataacatatataacatatattatgtataacatatataacatatattatgtataacatatataacatatattatgtataacatatagtatatatattatgtataacatatagtatatatattatgtataacatatagtatatatattatgtataatatatatattacattatgtataatatatatattacattatgtataatatatatgttacattatgtataatatatattatattatgtataatatatatattatattatgtataatatatataatattatgtattttatatattatattatgtataatatatatattatgtataatatatataatattatgtattttatatattatattatgtataatatatatattatgtataatatatataatatgtataatatatatattatgtataatatatatattatgcataatatatattatgtataatatataatattatgcataatatatattatgtataatatataatattatgtataatatatattatacataatatataaaatatattatgtataatatatattatgtataatatataaaatatgttatatataatatataaaatgttatgtataatatataaaatgttatgtataatatataaaatatatgtaatgtatattatgtataatatatgtaatgtatattatgtataatatataatgtatattatgtataatatatatcataaacatgtatcttatgtataatatatatcataaacatgtatcttatgtataatatatatcataaacatacattatgtataatatatatcataaacatacattatgtataatacatatcataaatatgtataatacatatcataaatattatgtatgatacatatcataaatattatgtatgatacatatcataaatattatgtatgatacatatcataaatattatgtatgatacatatcataaatattatgtatgatacatatcataaatattatgtatgatacatatcataaatattatgtatgatacatatcataaatattatgtatgatacatatcataaatattatgtatgatacatatcataaatattatgtatgatacatatcataaatattatgtatgatacatatcataaatattatgtatgatacatatcataaatatatattatgtatgatacatatcataaatatatattatgtatgatacatataaatatatattatgtatgatacatatcataaatatatattatgtatgatatatatcataaatatatattatgtatgatatatatcatacatatatattatgtatgatatataccatacatatatattatgtatgatatataccataaatatatatatgtatgatatataccataaatatatattatgtataatatagtatatattagatataattatacataatatatgtaatcatacataatatattatatattatatataataattatatataatatacataatatattatatgtaatcatacatattatatattatatataataattatatatattatacataatataatgtataatatatataattatacataatatattatatataatatataataattatatataattatacatattatgtattatatttaataattatatataatcatacataatatataatatgtataattatatataacataaaatatataatatgtataattatatataacataaaatatataattatatataacataaaatatataattatatataacaaaatataaaatatgttatatatattatacataatatacaatatataaaaatataatatcaaatatataatatatatatttccaaatgatacagaaaggaatgatatcattaaaataaatatggctaaatattaacaattgttgaatctaggttgggcatgcaggtgttcattatatgaatcctttaacttttctgaatatttcaaaatgtttataacaaaagtttggagaaaagaacaactggtcttcaaggccttcattttagtgacaatctgggttaaattgtaagtaatttttatgtgaatattgtataagaaatacatggtgctctattttgattatttgatttaactcggtgtatatcactgttgagcatatctgcatgaagtactgaaaatgaattcattataaccaagaaatcccgatgtaagagcatagacacactaaccctaatgtatgtttgttactggattgatttttcagctatggtatgaatttgtcttttcctaagaaaagcattcacacacatgttgctatttcagtgacataaagtatctcctggaaaatcatacattactcattcagccaaaatttagtgacaccctactatgtgtcaagccctgtgttggccttagggatacatcagtacatgaaatgaggcctctgccattgggaagccacaggccgcagactctcacatgcctaaggacagccgtgcccttgcccatggaaaagtgcagggttctctgaagattttgcttgcatgtaacctaaaaattatgcattgcatatcctcatttcttgatgaatacaattttatattttatgtttaaatggtggcaaaagatgtaattccagtttaaaaattgagattttaaaataaaattgtttcattactcttttttaaatagtcatagtgtagtagctttataatctgtgtttgctaacttccatacctgaggtctttgtggatggtttctgctacctgttgtgtgttagttcttgtgctacgtgtgtgttgtcacacacacacacacacacacacacacacacatctatctgtcaaagaatctccacaaataaatttctagggacaatgagtagcacacaggtatattcttccacagagaatttgtgtttgcttttgccaggtgcttagggggtcccagcagtccaagattacatcaaactaaactcactgcttaagattattggatcactagggtatgaatttggggtacagtctatgccagggctgattcatggccataacttttctggaacttttaaaaaataaggctcagataagtttcctaaaagtctccaggagaagtcagatttacttggttcaccattcccctgagagagcagctgtgtgggtcttgggcgaggctcctggtggaaggtctcttaacagatgccttcccttgggcaggctctgggctttgacagtcgtcctttttgctgctagaaactgtcaaatagaagttcaagtttgcctggttcagcaaaacaaaagcagccttcatgttccatttactttttggtattctctcttgtccttagattttggcctggtaggccaggcatggtggctcatgcctgtaatccagcactttgggaggctgaggcggacggatcactggaggtcaggagtttgagaccagcttggccaacatggtgaaaccctgtctccacaaaaattcaaagattagtcaggagtggtggcacatgcctgtaatcccagccactcaggaggctgaggcgggagaattgcttgaacccagaaggcagaagttgcagtgagcagagatcacaccactccagccttggcagcagagtgagggagactctgtctcaaaaaaaaaaaaaaaaaaatttttggcctggtagttaccttactatttttgtcaggcgttcagtgcttttaggaatctgttttctatattttatatagaatttccaattgttggtctaaaaaacccagtctgccatagtcttagaaagggaagcgaacatcaccacttttctcagtactttaaatgagaggttcttttaacctaggattcatgcatggagttcaaggcatctatatacccccctgaaatttcatgcaatgttttgtgtttaaccaattttttctgggaacaaaatccatagatgttatcagattgttaaaggtgccagtgatagagacaccctcaaatttgataactattgctttagagttctatcagtacctagtaattttaattaaaaaatgattttagaatgatttcaaactcacagaaaagttccaagtagagtgcaagacaatctccacattgtcgtcacccagattcgccaatgttaactctgccctgaccccacacacaattagtctttttctgaaccatttgggaacaagcttcagacctgagtccacgttacccctaaatgctatagtgggtatttccccaaacaaggatcttccaaatcaagaagttaacatcgctacaagaccgttcacagaatctatataagtttcaatttttcaatttcaactgtcccaagaatatattttttaaaaaattggactgggtgcagtggctcatgcctgtaatcccagcactttgggaggccgaggcgggtggatcacgaggttaggagttcaagaccagcctggccaagatagtgaaaccccatctctactaaaaatacaaaaattagccaagcatggtggtgggcacctgtaatcccagctactcaggaggctgaggcagagaattgctagaacccaggaggcagaggttgcaatgagctgagatcacgccactgcactccagcctgggcaacacagcaagactctgtctcaaaaaaaaaaaaaagtgtgtaatatttacttcacaggattgctatggatgttcattggacataataaggagtttggttagttgtcattgttagtttgttacagttacactgtgtccccctacacttcccctcttactcattgcttattggggtatggaaagccagcattgctatagcattctcgcagcacagtacacacacacacacacacacacacacacacacacacgaggctggaatcatgggtatactatgtctttaataaaggatctttcttggccaggcacagtggctcacacctgcaatcccagcactttgggcggccatggtgggcggattgcttgagcccaggagttcaagaccagcctgggcaacatggtgaaaccccatctataccaaaaacaaacaaacaaaaaaacaaaccacaaaaattagctgggcgtcatatgcctgtagtcccagctacttgatactcgggaagctgaggtgggaggatcacttaagccagggtggtggactgttgcaatgagccaagatcatgccactgcactccagcctcggtaacaatgtttcaaaaaaaaaaaaagtatttttcttgattggacaatgagaattctaattgtaatggatatctattgtttggtcctcccccttcttgtgggaaacggtctttctctacttccacaaggtagtgtacattgttcttacctgaaatggcagttacaagaacatgacaatgtccatgttcttaaagatcctagatctttggcacaatcatttgattcacggacaggcaactagctggaccaatgaactagccttccctgagaatttttaacttgggactagagatcatcatccttacctcgcctgtctgatgatgaggcagaagatgaaatgttgggagctgtcagtggccttgtttccagacatatggaggaagctggtctaacagcatgaagccaatgtgcagagagagttgcagagctgagccataggggcagaggcattctcgttctagtagtcccagcagtccctccccttcttggagtctgtccatatcaacagtacattcctcccttctgcctaacagttgagttcctgtcaatggcaaccaagagaggtgtgactgattcatgtattcaaagggctgttgtgagaacttgtgcctgactcacagtggggactcaacaaatgttggtttattactcttatatttaacgcctaaagtctgaatgcgaaaaggttagggcaattccagaaggaattactatgcagaagggaaaactggttgacaggttaactttcctttgaacatcacaagggaaggcacctaaatacaaaaggaaggcttcctccacgccccccatacacacacattcccttcatcctaacctggctctgcagctccgagggtcacatacctgcccttggcactactagtacttcctccagcaagtctcagtctttctttcagaatccttcgcccttatgccatgtaacatctgatcggcccggtctttgcccctagtatcagcaggccaatacgtgctctgctacaggtcttacagggagggtgagctcttggagttggatcagaaggagaggggctggggaaagatcgtcttcaaattgtttctttggcggtagtatatataaacatatttaggcagggcatagtggcacatgtctgtaaccccagcactttgggaggccgaagcgtgaggatcgcttaaagacaggagttgaaaatcatactggtcaatatagtgagattgcagtgagccattatcgcgccactgcattcctgcctgggtgacagtgcgagaccccttctcaaaaaaaaaaaaaaaaaaagaaagaaaaaaatcataagcaaacaacaacaaaaaaacaaatataaagaatggcggtctgcttaattctccgtgccagcccttgaaatcagtgggtattattatgtagagtttgagttctttcctcccttgagtaacatgagtgacatcagtaacattagtcaagcgctgctctttttgaaagactgtatttcattatttttattctaaaccttactctgtttgatgaagattgggggaagagccctcccaattccaccgctcacacataacagcggttgctagcattctttatttgtgctaggtcatctgcatattgtttaaacatttttcgaggctggaaagactgctcccactcaggcaattctgacgtggcggcccttctaatttatattctctaaataattcttcatttagagaaaacagtcagggattacagtgagggagggtgacgtgctgacggggacagagcttggcttttgatcattctccccttagctctgcccaggcaagcgtccctaactcagggtatcggaaccgatctcccttagaggattatgtttcaaccaccagcctcagcggtttactcaaatgtccttccagccaaatgcagaagtctccctgggagtaattttggtgaagtcagcttttgcctttttcatcacaggcaggctttagtagttcctcaaaacgtgcaccacaactgcccggctgccaaacagaaatgctgatgcctgggcccactctagccatttggcctcggcatcacggtgcgggagcgtggggcgcagactcgcattgtcacaggaacctcccggccttccgaagagccccgcgccggggcctttgtctcgcacgtcggctggggcgggagctaggttctcgcagcctcctcccaccgctctgcgccttctttgtccctccagaagccgccatcaaagctcagctcctgattaggtttcggccccgctggccggcgcagtctcggcgactaccccaggcggcctggcgcacgcgaggattcgccgcgccccagatgcaggtgcctcccctccttagccgccgaccgacagtgcacgccgcggccgccggaagtgacagcgcctgtcgttggggagctcccgccccttccgcctcggcgccccgcccaggcctcgcccctaggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaaggtaagtcggcgacgcgcggcgcccgagcccttgcgtcggcgcccgggttcgtaccccggccaggtccgcggcgctcgaggtgggctgctggatcgcggcggggcggacgcctgggccgtttgtccacccgctgggcctctgggccggggagcggaaggtgaccctctgcgcgccccccgccgtttcccgcccgcgccgccgaggggggcggggaccctgccgggcaggggccggggccggggtcggggcctcggggctactgcaggccggcgtggcctcccttgtccccgccgtcgcgcgctggcccagaaaagggggcctctgtcgctgccgtccgggggcgttttccgcacccttcccccactgggttttgtctttctttacgtccttctgcctattgctcgccaggccctaccccctcgcgacagaacttctttgttgactttgaaacttcgcgaaaaataccccgccagatgacggccgagtggagtgagctgacccctgttgaaaagcctggtcctcggcttgcctgccgctcgagaatctgtttactaaacggggaggctcttttgttgcgatccatttggttttaaatccttgacacctataagcagggttctgtttgttttgttttgcgattgcttgtgttttggatacggttacattgaacaaactgacccttgtaaaatgaatacttaagatataaacgtccacaccttatgtctcttcaaacgcattttcttacccactgaaggtagtagattatttttaaccagctgtgtttttaaatgagtggtgagtttatagaggaaattactaaattttgctttttttgatgttccggttatcgtgcaaatgcttttctactttaggtatatttatgggggtatgagcgtctttcaaccttatgggttgcgattttggcgattttaaacgaaaatgaattatcaaacgccgtcatggagtgcaataatgagtgaaaaaagtttgatattatctatgtaatgagttgataacgacttatttttttttaaagaagtcttgcctttaataaatacctcaactataacatgtggcacttgatgtacattcgcgttccatcttcgtaaaaagcctgtggaataggtaggtattatcttttatagatgtggaaatgtaggcttcgttattttaatagcttgtcgaagctttacacaggtagtaagaggcagatttgaacctaggcattctgattgcaagtaatttccctttcattatgccacagtgtgtttattatatacactgagtgtagctaatcgccactggagacgcctttggaaaaaatagtaaagcgaaactgctgaaggttgcgaactatttctttttgacaggtggtccttgcgtgtaaatttccatctacataggtttcacatccttttagattcaggttttaatgagtaaatctagtaaggcatgtatttatcacaggataggtacggacgtattacattcaattctcattcttttggcctgggcattgctacttgcatacttttatggtgtgacagtaatctgtggtaattcaggaattgcgctcgaagcacgtatggaatcatgaaatattttcactgtacttctagtgcttaaatatattttttctcttgtaaaattataatcaggataaggtatacataacatttatttattgaacactgttgcctgttaaaataacatgtgctgaagactcaacgtgtagtatgtgctttactaaacactttatatacatttcatttaattctctcacatcgttaggtagtcggcattttcattttacagatgaggaaactgatggttagtatgattaagtaacttgtccaggataatacaggtagtaaatggcagaggcaagattcagactcatgtctgtcagagtcgcacttaaattagattatttatttatgagtgtatactacaagtccaatgttgaaatttatttttgtcactccctctataggatgaatcatttatataatttggtggaaactttattttgctttattttgttttatgaaattattagtcatgaaatgcaagtgaattttagtgccgtattctcatgcctgcttttgcaaaattccagtttggaagtcttctgacatttttacaattaaatttaagttgaaataacacttaaaggaaaagggagggttatagaggattaaaaatgatatagcaaagatgccaaaaaactaataaaaaatgttctatttgtgaaatcagttattataggttatttctttaaaaaatgcgacttaggttttttaaatctgcttagaaattttttggtaggagatattcaaagtatggccaaacataaaactaaattaaaaaaaaatcagtatcacctacttttgaaaacacttatactgttgtggttctgttttttatttattttattttattttattttattttattttattttattttattttattttattttattttattttccgagatggagtcttgccctgttgcccaggctgaagtgcagtggcatgatctctgctcactgcaacctccacctcccaggttcaagcgattctcctgtctcagcctcctgagtagctgggattacaggagcgcgccacctccctctgctaatttttgtgtttttagtagagatggggtttcgccatgttggccagactggtctcaaactcctgacctcaggtgatctgtccgcctcaacctcccaaaatgctgggattacgagcgtgagctaccgttcctggccggttctctgtcctttaaaaatatattttaatattctgagcaaagagattaagaatgttacaaacacatcaaccgtgcgtatagtaagtcttcccttccttttaaaaatagcacattgcttgcctctgatggtaccatatatgatagtctgatgctcagaatgttatgcatttgtagtaatacttagttccgacatggctgtttcatactaattgtttgctagattttaaagatctctaaagtttcttcagtattaaattaatttttgtaaaatcaacaggtttataatccattctcataatacagggatggataaatcattcttactgtgtatatgttatttgtatgagtgcagatgtgttatgtcaactgctatccatcctgacatttttaaacttcagagctataggagaccttagacatttgccctcctcattttatgggttaggagtccgatcctgtaatgcactgagatttctcagtttcagagaaaagtctatcctttggtcaaggatatacttttttttttttttttttaaaggaaaagcagtacaatattggaatagatgttgcaagtgttgatgtgcagttctcaaagataatattaaacattttgtcatagaatgcccacatttcggctcagtgatataaagctgaggtttttttttttttcttttccattttgctaaattactgcttgtattagcacaacataatacaaagtcttagtaattttattacagaataccaaagcagctgttctttatgctttacggaacatattcattcgaaaagtgtgaagctaaagagtattatggttgatcatgttctatatcactatggcaaaaatttgaggtaacttaaatttggaagaaatgagttaaaaggatagaaagttgtcagaatcagacagctagttcctctctttctagacccacacagtcttctttgtttccagagatgtctgctgcatgtttcttaccacgcattacctttcactgttttggcatgcttgtgaccaagtgtacatgcatttattcgttaaatgtttactgaggacctgttatgagccaggcactattctatgcatttgggctaggcaaggaacaatatagagaaaatcctttctttcatagagcttacattatagttattagcttaagacaaaataaacatgtaaattatatggcataactagaaggttataaacgctgtggagaacagtgaattgggagggaataagaagtgccaggatatgagggcatgggttgctttttttttttttttttttgagacggagtcttgctctgtcacccaggctggagtgcagtggcgcgatcttggctcactaggggtcgcagttttaaatatagcagtaaaggaaggcctcactgagaaggagcaaaggagaaggagttagccatgcagatactctgggcagagcattccaggcagagggaacatagcctatgtgaagtgtctaagatgggagcatgcctagagtgttcaataaatcaccaggagagcagtgtagctgtaacggagtaaaagagttggagaagagtaagtataatatgaggtcagaaagatatggagccaatggggagagagcatgtaggacttcattgacttttatagtgagatagggagctatgggagggttttgagctgacgtgagacataaattgtcttgatatgcagccagctttctgtatttgtgggtttcgcatctgtggattcatccaatgtcagatggaaaatacttggaaaaaaatagatgattacctctgtactgaacatgtacagcctttttttcttgtcattattcctcaaacaatacagtatgatgactacataacatttatgttataattattctaagtaatctagagataatttaaagtacagttgactcttgaacaacatgggtttttgaactacatgggtccacttacacatggatttttttcttcaataaatatattgaaaaaaattttggagatttgcagcaatttgaaaaaacttgcagatgaactgtgtagtctagaaatagtgagaaagttaaaaagttatgtcattaatgcataaaatatatgtagatactagtcttttactcactatcataaaatatatacaaatctgtcatgaaatgttaaaatttatcaaaacttacacacacaaacatgtaatggagactgtacatggcaccattcacagttgagagatgtaaagaaacttaaagatacagtattaaatcataactgcatgaaattaaccgtagtgcatactgtgctactgtaataattttgtggccaccttccgttgctgttgttgtgagctcaagtgttgctgttgttggagctcatctctccagtaaattgtatatggtaaaaagtatctctctggattctcttgtatttttcattgcatttagtgcagtaccctaaactttgaataacatgatgggatccatatgaggtgccactaagtgatgctggaagtgctccaggaagctgaaaaaaggcatgacattatgaagaaaaagtcgaattgcttcatatgtgccatagattgaggtttgtagctgtggttgctggccatttcagaatgatttatcttgtaaacagacaggtatcaataaatatggtacagtgctgtaaatgtaatttccttctgattttcttaatttttttctctagctttattgtaaaaataaagtatataatatagaatacagtatataatattacaatacatattgtaagaatgcagcatataatacagtacgcaatacatataatacagtttatgcattcatggcataattttattttttttgctccttctaagctacacagttcatctttttttaaattgttgtgaatttccaaaaaattctccaatatatttattgaagaaagaaatccgcgtataagtggacccatgtagttcaaactgtgatgttcacagatctgtactttaaataatctcctgagtactcataatacctagtataatgtaatacaaaggctgggtgcggtggctcacgcctgtaatcccagcactttcggaggcggtggcaggcagatcacctgaggtcaggagttcgagaccagcctggacaacatggcgaaaccctgtctctactaaaaatagaaaaaattagctggatgtggtggcgggtgcctgtaatcccagctccttgggaggctgagacaggagaatggcgtgaacgtgggaggcggagcttgcagtcagccgagatcgcgccactgcactccagcctgggcaacagagcaagactccgtctcaaaaaaaaagtagtacaatatgtgtattaatctactgtttatgttgtattatgttatgggaaggcttctggtcaccagtaggctgttagtagttttccattagtagtttttcgggagtcaaaagttgtatgtgtgtgtgttttttttttttttttttttttgagacagagttttgctctttttgcccaggctagagtacagtggcaccatctcagctcattgcaacctccgcctcccaggttcaagcgattctcctgcctcagcctcccgagtagctgggattacaggcatgcaccaccatgcctggctaattttgtatttttcgtagagatggggtttcatcatattggcttgaactcctgacctcaggtgatccatctgcctcagcctcccaaagtgctgggattataggcgtgagccaccgcgcccggctgtatgtggatttttgattgtgcaggaggtcggtgcccctaactcttgttcaggggactcctgtatatggaaggatgtgcataggttacttggaaatactatgctgttttacataagggacttgagcatctgtggattttggcacctgtggacttcctgaaaccaatcccccagggttactgagtctatctctttcctggttaagacaagtttttgtttgtcttaaattcaaatttctggaagctacaatctcactggctcatcttgggtcagttgcttatccttttgatccaggtagctgggtggtggtgggaaaggtaatggaagaataagaatcatgactggctgtgtccattcttgagctggtaagacagtgcaaaagagatctgctatattgctcaattagaatactttttagactgaagccctgtgagtgattattgctgggctatcctcttccagatgcctacttcccatttcttccaggccaggcttactttagtgggttttacttctgtcctgtaagactatgaagatcacttatttttagtataatacagttagaacagaaagagttcttgaaaagtgaataggaagtaagaaccccccaagggaaaacttaataattcagactatattttagaatgctgttgcagtaggctagatgagatataggagttacattaaggtagagggaatggaaagaatggaaaagaagaaatagaccaaggtagaattaatagaacatagtaattgaagaggtaatataaggaggaggagttaaaaatgattgatttttatattatttcaaatgggaatggaaagagataagtagttcagttttagatattgttttagtttgcaggggctgctgtaacaaagtactacagattgggtgcttaagagaaatttgttttctcaactctggaggctagaagtttgagatgaaggtgttggtaggcctggtttcttctgaggtctctctccttggcttgtagatgattgtcttctgtgtcttcatgtagtcttctctctgtatgtcttcatgtagttgtccctctatgtcctaatctcttctttttttaaagacgctagtcatattggattagggcctactctaaggacctcattttaacttaattacctctttaaagatcctgtctccaaatatagttacattgtgtatacatgcaggttagggcttcaacacgtgaattacggggggaggggcagtgcaattcagcccatgatagacatgaattcttgaaggcttggaagactgaagcattccctgtacacttattttttataacttaacttcattataatatctttttttttttgagacggagtttagctcttgttgcctaggctgcagtgcaatggcgcgatctcggctcatggcaacctccgcctcctggattcaagggattctcctgcctcagcctcccgagtagctgggattacaggcatgcaccaccacacctggctaattttgtatttttagtagagatggggtttctccatgttggtcaggctggtcttgaactcctgacctcaggtgatccgcccacctcggcctcccaaagtgctgggattacaggtgtgagccactgtgcctggctgtaatacactttttactttcctgtctctctccttcccttctgtcacctcttaatgtattctgtaaagatggaatcaggttaataaagtataatttacacacaaatttaccctgtttagggtgcagttctgttataacacttttgaaatagaatattggagattccatgtcttttttgattacttccccatttaccaaatattgggtacatgtctactacgtatctaggacctgtgcaacaatgttttctgcatgtttcatttcttcattccaagtccttgaaaagtgccaagaggcatttctattgaatggaacagtttgaagagcattgatgtagctagagtagtggttttcaaagctttgtcccaagacccctttacattcttaaaattgaggacccaaaggacttttgtttatgtgggttttatatgtaaagatagatatttaccatattagaaatgaagaatgaatacaaattatttagaatatttaaaagtaacaataaactcaatatatgttaataaaaataacgttatctggattattataagacaattggattctcatctctccctttgcagtcactttgttaagtgttttggttagtgtatataaaaactcggcatcacacagatttatagcttgaaaagggatgaatattttcagatgtttgtatgttctttgatactatgtcaaaacttgacaagtggtagtttcttaacgtatctgaaaacatggcagtcaccttaaaaaattaaattaactgttaaattaaaatccatttgtctggtagtgtaggatagagtccagaaatagatccacacatacatggacagttgatttttggacagaagtgcaaaagcaattgcataaaatataaaggatatcgtttttcaacaaatggcactggaatagttgaatagctgtaggaaaaaaaaaagaactttgagctatagcttgtaccatataccaaaattaactcaaagggctgttagacctcaatgaaaaacctaaaactatgaaacttctaggggaaaatataggagaaattcttcggaatcttgggttagaccaagatctcttaggtatgactccaaaagcatgatccataaaagaagtggataaatcagatggcatcaaaattcagaatttctttcaaaattagaaagacacttaacagaatgaagacaggatacagaagatgtatcttataaggggcttggagtatataaaaaattctcagaactcagtaataagaaaacaataactcagtttttaaaatggtccaaagatttgtatagacacttcactaaaaaatacatgtacatggctattaagcatatgcaaatatgctaagcatcattagtcaaaaccataatgagacaccacttcacacctgctaggatggctataatcagaaagaacaggtaagtgttggtgagcattgtagaaaaattggaaccttcatttgttacgctaggaatgtaagatagtgtgactgattttggtaattcctcaaaaagataagctgagtaaccatatgacccagaaatttcatatacccaagagaattcaaaaaatatattcacacaaaaacctgtatatgagttagcagtattatttataatagccaaatagaaacaacccagtgtccatcaactgatgagtagataaatgtgatctatttgtaaaatagaatattacccagcagttcaaaggaattaagtactgatgcatggtacaacttggataaatctcataaacattaggataagtgaaataagccagtcacaaaagaacatattttctatgatcctatttgtgtgaaatgtccagaataggcaaatctatatatagagaaattagtggttgtctggaactggggagagcagatggagtaggaagtatccactaatagttacagggtttccttttgggatgatgataatgttctaaaagattatggtgatggttgcgtaactgtaaatatacttaaaacaattgaagtctttaaattggtgaactttatgacatatatctgaataaaattgttaattaaaactactgtgagatatcattacatacctattagtgtggctaaaatggtaatagaatgactgaccgtaccaagtgtttgtaaggaggtagagcagttggaattttcatatactgctggtgggagtgtaaagtggtacaccacttcttctggggagcagaaagcaaccttccgggtacaggtgagccaaggttgatgggcagttatgcagagggagttgggatatcactgtgtgtacctgtgcaagtcctggagtgtgttgggtcctcatcagcagggctgtatgaaggtgttcattaaaacaaaactactgatagtgtggcaggagctagaaaacacccctttcttcttagatatccctccagcaccctctactggcaaagtttaactgcccctagccaaaagaaaagaaaagaaaagcttagcatccctatcactgaacagggactgaaagggagaatttggagttgagaaggggatacatggataactagctcattactgctgaaattgttggaatcattcattgcctgtgctgctgaagcttgatgttgcccacagctgttgggcagaatctccaccatgacttgcgtatctgttagcaggagtctgcagtacctgccattagctgcaactgctggtttttagaaacaagtagaaaatggtttcgctgtttctctgcttcttctttatttttatttttgagatggagtttcgctcttgtcgcccaggctggagtgcaatggtgcgatcttggctgactgcaacctctgccacccaggttcaagcgattctcctgcctcagcctcctgagtagctgggattacaagcacatgccaccacgcccggctaattttgtatttttagtagagacggggtttcaccatgttggccaagctggtcttgaactcctgacctcagttgatctacccacctcagcctcccaaagtgctgagattacaggtgtgagccactgcacccagcctccctgcttcttctgatctcacagaagtgcttctcattgacagactctaacttaagcctagttggcaaggaggccagaaagtgcagttttcaggcttccaggagcaacagtacaggtgaatttttaatttagtaacgatagtaatctggtgagctaaaataagtaaactttggggtacatagagaattggaattattattattattattatttttgagacagagtttcgctcttgttgcccaggctggagtacaatggcacgatcttggctcaccgcaacctccgcctcccgggttcaagcgattctcctgcctcagcctcccgagtagctgggattacaggcatatgccaccacacctggctaattttgtatttttagtagaggtggggtttctccatgttggtcaggttggtcatgaactgccgacctcaggtgatccgcccacctcagcctcctgggattacaggcgtgagccactgcacctggccgagaattggaatttttaaactgtgtttgcaaggcctaattcccaaacccacatagtttgtgtatgggtatacgctcaccctcaaaaaggaaatattttttgtaaaatttgagcagttaaacatttttttctgcctgtaattgtaaaagtagcaattaaacactatctacttggggacgagaaaggaagaaaaattacccatgttctcgtctgaccaattacagtggctgtcttttttttgcattttcttctttaggctatggtgtttttacctagttggaagtaagggagtgtggtcatttaaaaatgttatatctctttccatattagcaaatagttatatatacatatatatactttttttttgttttttggtctgttgcccaggctggaatgcagtcacgcaatttcggttcactgcaacctccgcctcctgggttgaaatgattcttgtacctcagcctcctgagtagctgggattataggcgtgtgctgccatacctggctagtttttgtatttttagtagagatgggtttcgccatgttggccaggctggtttcgaacttctggactcaagtgatccatcttgccaaagtgctgggattacaggcatgagccactgcgcccagccttgtatttgctatttttaagggactgtatacattccatatagtgaatgtgcaccatttatatagccgcttccctattttgggctatataggttatctgcagacattttgagtaatatttttaatatattttcaaaattgtctactataattgtagctactaattgtaaaaattttattgataattacatattaaacattccttgtttacttcagccagatgaacaaggtcaacattaacagttacatgtggcatagtgccacggttattacttgagactgtcactatgacagttactgctgttactacttgagaccgtcattatgagactgagtgaagggggacaaatgtagaaatgaaaaattaagacaaaagaaacttttaaaggaagaaaaaaggggaagaaaaagagggctccctgcttctagggagcaaaggcagcagcctagcttccacagcccttagaatttattgggtagaaagagcaggggggaggtgataatgactggtcagctgcttaattgatcacacgttcatattattacgaacaggcttcagatgtacctaatcacaagaaactgagcttggggcgtgactgccttcagcattccttctgggtggcataggcagtttgtcagtttgccaacattctgcgtttatgagaacagtttgctgttcactcttatagcctccagtggtatactgagttgatcacgaccctcagtctttcggcctccaacagttacaaatcatgttgatggcatatcccttgatatgatatgatatgatataagatgccacttcatgtgatttttttccttcccaaaacccatagccccagtctattcatgaatcatgcaatttccagtaaacagacattctacagtgtacctgaccagtactccttaaaattgtcaaggtcgtcagaaacaaggaaaatctgagagactgcccgagcccagaggagcccaaggagacatgacaactaaatatatgtagatcctagaacagaaaagggacgttaggtaaagactaaggaaatcagaataaaccatggatttgagttaatgacaatgtatcaatattggttaagtgtaacaaaagtgtaacaaatcctaataagatgttaatagtaggggatattgtgtgctgggtatatgggaactctgtactctcttcatattttctgtaagtctaagacttctaaaatctaaagtctgttagtaataaaaaataattctttgtatattaaattatcactgatttaacaccagaaggtaagtggagagattttgaagtcttacatcaaagaactttcaagatagataatagcttaagagttataacatgtaccccaaaacttagagttttatttttttcctcatactaggcacttaggataaattattgaactgtactgttggctagaaaaactttgatgaaatgggctgacttccacagtggtggtggttttctttctttctttcccatctcctgggcaatctccacaagaatttgaaaaattactaaggacttgaagcttttttttaattaaaaaaaccactattgtttattgagccaagctctttggtggaatctttaaaaggtatccatgtgtaaagacattaggtattcaaatacagcaacaaaaattgctacaggattaaatagaaatttccctttgaaaaccaggaagagctttgccatattgtttctaagtaggtttgcgttcataacaagcaagatgcattgattttactttggcctgagcaagattcataattttactgcatacgaatctgatgggggggagcctcaatctgccacagaacctacttcggtggtttaatttttagtaaaggactttaagctgagccctttgtagacttcactctttttgtagccttggccttgttactctgttgaggttttgggtggtgggattggaactagtatacaaaacaggctattctttttttgactttgtatgtttgtaatagtcgtacttgcttcatgtttttgcaaagctgctaagattctgtataaaataggatcagctaagttatgtcgtagtcacaaactaccctaaacctcaggagcttaaagcatcaaaaggttaatcacttcttggccaggcacattggctcacacctataatactggcagtttgggaggccaacaccagaggattgcttgagcccaggagtttgagaccagactgggcaacgtggtgatagagagaccctgcctctacaaaaaataaagaaaaatttagctgggcctggtggtgtgcacatgtagtcccagctgggaggctgaggcaggaggatcacttaagcccaggagtgttttttgtttgtttgtttctttttgagatagagtcttgctccgttggttgcccaggcttgagtgcagtggcgtcatctcggtttgctgcaacctccacctcccaggttcaagcgattttcctgcctctgcctcgcaagtagctggtactacaggtgtgcgccaccacgttctcggtaatttttagtagagatggtgtttcaccatgttggccaggctggtctcaaactcctgatctcaagcagtctgcccaccatggcctcccaaagtgttgggattacaggcgtgagccaccgtgcccagccaggagtttgaggctgcagtgaactatggttgtgccattgcactccagccttgatggcctggatgacaaagtaaggctctgtttctttaaaaaaaaaaaaaaaatttccaatgtgggtggagggggaagtgcttttgctaactgtagtcactggggagcccagcttgatggaagctccatcccttactgcatgcttccacgcccattgaggcagggaaaatgcagtgtgatgaattgtgttcattggctttcagacacttctaccaagaagggatacttgtcattgtacctcatatttcattgaccaaagtaagttacatgtccatgcctaatttcagaggtggcagggaagtgcagtttcagtgtatgcccagaaagtggaaagtgagaaatatttgatgaccaatgctgatgatttccagtccctaacaacatcagtttctacctggttggatgaaaaacgtgtgctcattgggtgtacacttcaatctacaatttcattagatgacattttagagagggaacaagtatgtttttcatgtcatccttctttcttatttgttctttcttcccacatgtctgtgtagacagtactgtagaaggcctgtcgatttcatttttcaaattaaagtataatttaaatacagtaaaatttaccttatttaatatctattttgacaaatacatgcagtcatatagccagcacagtcaaggtatagaatagttccattacccccccccccccttgcaaatatcctttacccttttatggtcaactttgtcccccatttccagcccctggcaactactgatctgtttctgtccctatcattctgctttttccagaatgtcataaatagaaccatacagtatgtagtcttttgagtctggtttctttaacttaatacaatgtttgagggttatccacatcatcgttgcatgtatcactagttcatttctttttattgcttagtattttattgtagggatgtaccaaagtttatctattacccagttgtggaattcttgagttgattgtttctagttttggggaattaaggatgaaaccgttatacatactcacataggtttttgtgtgaacataagtttttgttttatcaggttaaatatatattagtaggatttctggattgtctggtaagggtgtttttattttcatttttttgccctttcaataggtatgggagtatcttactgtgattttttttttttttttttttttttttgagacaggatcttgcttataaacccaggctggagtgcagtggcgccgtcatagctcgctatagcctcaagctcctgggctcaagcaatctttctgccttagcctcctgagtagctgggactacaagcagacgccatcataccctgctaattttaaaattttattgtagatatgggggtctccctatgttccccaggctggtcttgaactcctgggctcatgtgatcctcttgcctgagcctcccaaagtgctgggattacaagtgtgagctgccatatctggcgttactgtgatttttattaaaaaatttgattgtggtaaagtatatgtaataaaatttacttattttaactatttttaagtatatacttcagtggcattaaatacaccttgttgtgcaaccatcaccatcttcttgtgatttaaatttgcatttcttgaatgacttgaacatttaaaattttttattcctctttcggtgagtgtgttcagatcttttgctgattttttttcaaaccattttctttcttttttttaactaacccagcacaaagctgattttttttttagttttcttactgttgagaccttgattagtaaactggacaaagaacttgaacagatagttcacaaagaaagagaacttggtaaactgtggaaatgttcaggttggcagtaataaaaccactttttaattagctgctgtactacctggttattttttatctttatatttcagtaatgtatgttttactcgatggagcagtctactgtgcaagtgggagaatatgataaagttggaggagcagataaatagaatattgacattatgaaaaaaataaaacattcacgataacctggttgcttgatgaaggtagttgtggggaagaagcatgataaggtcaaaaggagagtactcttggaattgggagctagtttttaatcctcatttggcccttggttgataattacttggttctcagtaactgaaatagaattagctattcttagatttccagccagttttctgaaagtgtgacagttcagtgataccctagatctcttgtatactgccttctccttagtcttgtgtggccttagatgtgttatattaccctacccctttcaacctcagtttcccaaactatgagattggtattgtgaggagtaagtgacagaatacattcggagtgcttagaactgtgtgtagagatggtaggtgtattagtctgttttcatgctgctgataaagacatacctgagactgggcaatttacaaaagaaagagatttataatggacttacagttccatgtggctggggaagcctcacaatcatggtggagggcaaggaggagcaagtcacagggatggcagcaggcaaaaagagagagcaagtgagcttgtgtgggggaactcctgtttttcaaaccatcagatctcatgagacttattcactatcacgagaacagcattgcaaagacttgcccccatgattcaattacctgggtccctcccacaacacgtgggaattcaagatgagatttgggtggggacacagccaaaccatatcagtaggtaatgaaataaagggtagttcttagctgatgtcaaagtaacaattgaatgttgtgcttttttatacttttttttctttgaggcagtggctggtcttttaaaatgccttcattaaagtttctagtacattataccaaatagaaattaaaagacatgcaagttgctgctggctggcatctataatcccagctattcaggagtctgagacaggatgattgcttaaggccaggagtttgagactagcccgggcaacatagtgagactctatctcctaaaaaagttagctgaatgtggtggtgtgctcctgtaatgcccactcctcatagatatttcaaaatagtaatatttattgctgccaatgtgagtaggccaaaaaaaaaaaagagagacatagagacatggaagatcaaatgccaattaattacttaaaattgattttgagaatatgaaaacatcattttggattttgatgttttctgctccataatggagcagaaaattaattttcattttccttatatttgtttttctcctaagacccaattgaggggggagaaaacccatagcatcttaaagatctttatttttttatcatgtctgtgtactattgttagtggatataatgctttatgaaatgtggtcatttcagtagttttataaaatatgttttgatttaaaagcatgtagcaatagtgatcattaatccattcattagaattttttatacttcattatacaattgactctgtgaaaatagatgctagggagattttaaagagttattaatactgcttggaaataataatatgttagaattccctttaggattattttttttccccacttgagacctaacctgtcattgttttcatataaaccaaaccacttaaagtaacaaatggattaatgcacttgttcttcctcttgacgaactccttgaagaacaattttggaagtatttattaatttgctttaaaataacaacactcattatgtgttaatataaatactgtttttcgtgaaaataactattccaaactcccaaaattgatgaggaaagtggatttgttttatatttgccaatctctttaatacctattttaatgagaagcagctgggtcttttcatctctagctgcattcattctattatctcatgtagcctctagaaaataccactgcaaactggcaagacaataagtgaaaaagaagtcttaggggctgggcatggtggctcatgcctgtaatcctagtgctttgggagctgagatgggaggattgcctgaggccaggagttagaggttacagtgagctatggtggtgtcactgcactccagcctgggtgacacagcaagaccctgtctcttaaaaaaaaaaacaaaacaacaacaacagcaacaaaaaacttaagtgttactaggatagtagttgtgtctttgcattctctgagtgagaaacttgggatcccagttctcttctctaggccaagcagagccctggggcttgatttcagagttgttgggtttgcttagtatcttgtttgttggtttgtcattcagaaggacaggggtcttctgaaaaatcagtgccctaattcatgtgtgtgtctacatccttctaagtggagatccatgtctctctccccactccacctgtcctgttccaccattcgctagctggccatccacttggagtcagcagtgcttcctgtggtgagtgtgccctggagtttgccactgctttggtcctgaccacagctttctcaggccacgcagggctaggttgtctaggtggcagtgttttgtatcatggaatgagcccaccaagtgaccaattgctgtacccacgtggatgtcactccacctgttgtccttgcctctcacaggcagcaatgtgccagcaggactgtctttgccataccccaggccatagtcaatggccgacccgtcacgatgttcctggagggcagcgtcccacgggtgggacaccctttgtcatgctgtggctgctataccctacttcctacttgcacagccatctgaatgtgggctagggagcccaaaccctatgcctgagatctgtacatccacacttgcacccaccctccctggtagatcctacagtagtagcacatgccagtttcaaaagttaatccacagtattgttgtgaatggctggatgagggttcagctcctatatagataactggttattgtaggactgatccgcacctgtggcttcagtgactctggtgattctaggtaacctagatcaatcacattttctccccacccccaccatggccctgtcactcttaggtggcagttgtagtgcctactgaggcgaccactgtgaccaagaatcttaataatagggaatctcaatttgattctgcagagagagagcctgataaattaataccctatctaaagaatgcagcaggcgcacaaattacccactcccaaccctggaggataatgattaaaacaatatagaactctttcaaggccctgtagttggaaagagtccagtttaaatcctttaaagaggatctattgcagggcaagcctggtgctggcagccacggtaatcccactttcaatgtggtgtgctgaattcctggcagttaaaatgcttgtttttggatcttaacgtgctgccggggtccattgcaagaaagtccatgcctcttgtctttttggtaccttacgggctcttcttccctgagtttccctggagctgaagtgtgcacttgaagaaaattagtgttcaaagtagcgtgggctgcctggatactgctggtgggaatcatggaatgggagcgtggttctattttgtttgtgttggaactttgaggaagcttattaagcagggcagttggggcattagtattgcaccgctaggactcaaattctgggccagtaataagactgatcagagtgaaagtttttgccaaggatgttttcattaaccaagaatgaaggtgaaagtgggaagtttaaagatgttcaggtcctgtgtagttacgaacataaatgtgatgttgaccactgcattaatgcccatgacccactagcagcttccaggaaaccagagccctttgggtcgtggtagggggaaggtctgtgttcatagctgaaactgaaaggcaacagcaatagagacagcttaatttgactgaacatgagcaaccttacctgcttccagcacagacaggattgtcccattgatagttattctgtgggtgggggtgcatggcttttctacttgatgaagagattttgagaggtgacagcatgctggcagtcctcacagccctcgcttgctctcggcgcctcctctgcctgggctcccactttggcggcacttgaggagcccttcagcccaccactgcactgtgggagcccctttctggcctggccaaggccagaactggctccctcagcttgcagggaggtgtggagggagaggcgcgagcgggaactggggctgcgtgcagcgcttgcgggccagctggagttccgggtgggcatgggcttggtgggcctgcactcggagcagccggccggccctgccggcccaggcagtgagagacttggcacccgggccagcggctgcagagggtgtactgggtcccccagcagtgccggcccaccggcgctgtgctcgatttcttgccgggccttagctgccttcccgctgggcagggctcgggacctgcagcccgccatgcctgagcctcccacccactccatgggctcctgtgcggcccgagcctccccgacgagcaccaccctctgctccacggcgcccagtcccatcgaccacccaagggctgaggagtgccagcgcatggcgcgggactggcaggcagctccacctgcagcccgggtgcgggatccactaggtgaagccagctgggctcctgagtctggtggggacgtggagagtctttatgtctagctcagggactgcaaacacaccaatcagcaccctgtgtgtttagctcaaggtttgtgagtgcaccagttgacactctgtatctagctgctctggtggagccttggagaacctttatgtctagctcagggattgtaaatacaccaatcggcactctgtatctagctcaaggtttgtaaacacaccaatcagcaccctgtgtttagctcaaggtttgtgagtgcaccaatctacactctatctagctgctctggtggggccttggagaacttttgtgtcaatactctgtatctaactaatctgatggggacgtggagaacctttgtatctagctcagggattgtaaatgtaccaatcagcaccctgtcaaaacaggccactcggctctaccaatcagcaggatgtgggtggggccagataagagaataaaagcaggctgccggagccagcagtggcaagctgctcgggtccccttccacactgtggaagctttgttctttcactttttgcaataaatcttgctactgctcactctttgggtccacactgcttttatgagctgtaacactcaccgtgaagatctgcagtttctctcctgaagccagcgagaccacgagcccaccagaaggaacgaacaactccagacgcgctgccttaagagctgtaacactcaccgcgagggtctgcagcttcactcctgagccagcgagaccacgaacccaccagaaggaagaaactccgaacacgtccgaacatcagaaggaacaaactccagacgcgacaccttaagagctgtaacactcaccgcgagggtccgcggcttcattcttgaagtcagtgagaccaagaacccactaattccggacacaatttgactggtagttaatcaataaccagggagattagcgtgctaaccagttaggtgagcattcggcatctcccaatttagacaaatggcattcagccatctgagattgagcagttaggctctggattgcccagctggttagcacacagatagatctctccaccagcctagaaaaggcatgcaccccactcacagaagagtagccacaggcctgtgatgctcttaaatgcctgtaaccacgcaccacactgctctcggcatgtgctcacttgaatccgatggatgtcagagacccgttaagtgcattagtgatggggatcgggattgtagtaagtcgtcgttaaggaagaatttcccgtgagagattaggctgaaagtgtgcattaagtttctgcccattctccctccgataggccactagggattggctcttggccctgacagatagctgagaacggtctaaaataaaagttataaccagggttccctaagtggacccgggtaggagctttagagcgagagtgcgaaggatccgtcgcggttcctctgccgtcgtgctgctttggggccactccaggcagaagacagacaaatatgcccctagagtcttgtagtgctgggcatgaggggtgggctgcggtccaaggaccccttagcgctgtcccttctgcttaaggtggcttccggctcatctctctgtggcctggtgcttttgtggctttggggtatcccctccccccaccagcccttaaagtgtgtgtatgtgtgtgtgtttctgggtctgcctaccttgcactcttgtggggtggggtgacatgaaaagcttgtcttctaactgctgttattgtggtgagtcctcacatgtgttttgtggagtttaggctgttaggactttaaaccgttaaattgttaagactggagtttaaaactgttaggacgctaatggtgacctgattttacatatttttattatttgttgtggagagcgcagttttgaataaaaccatctgtttctcttattttcgactttgatttatttaaaatctgtcatacgaaggaacaacttaacttttaatacattatttaggaattttttagttttagataaacacttgaatagcaacttaatcacaactttcagttctccgtactattaatgttttgtcaagtgatagattcttgctttaatgtccaatattttggtttatgcttgtttcttgcttttttaaaaaagttataaccaaaggaaattcaattttcctttttcattggcagacatatgtagagtgtgtcggtcagaaggaacacctgagaaaccgctttatcatccttgtgtatgtactggcagtattaagtttatccatcaagaatggtaagtcatacttttagaaagttatgtaagtctgagcttcagtttcgtcatgtatacagtaacagggatcatttcaatgtactttctctgtaattatttttaaaagttttattgtattttcctgagcacaggaaactgaaaaagcccttttattgtaaaaattaaaaaatttggaaaagaaattatccattaattcttaataccatggctgttattttggtgtatcctcttccaggtacacgtaattacccattgtttatttctaccatggagagcttattttgtcctctgaaagtgttatgattttctagttttgcttggcataatagtagcttacatttatgaagtactttttgccaagaactgttcttagtggtttgtacatctcaactcatttttaatccttataagaaaattgtgatgaggtggagtattattattatgcagatgaggaaattgaagcatgggaaggctagataacttgtccttggccacatagccagccagttagtggcagaaccaggattcagacctagctaccaggtaccagtattatcagaccaggattaaaactgatgttgatgcttagagattctttcatgttcattttgctttgaggaaattacagttttgattaattgaaccttttttaatggtagaaaaatgtgttgtttttatctctagctgttgtagtttttcattcttagaaggcagttacaaaaagttaagaatattctaaatttgaaaattttgaaactaaaagctctgtgatatatacatttttaataaaaacaatgttttcgacaaaactgtaatgtttctttgctgtaaacactgtacttatgaatctatttataattacagcttagttcaatggctgaaacacagtcgaaaagaatactgtgaattatgcaagcacagatttgcttttacaccaagtaagttctttagacattttcactgcattttttttggttatcactcgtggcataaaggtgtttgatatgatcagttgacagaggaagggggataaaagtgcttaagcactttaaagcaattattttcagcttgattttttttgatagtaataggaagtattgatatttaggaaaatattttgaaaaactgtatgctgtcttttatcacacacatgtttgagatttgtggggtgtttttttttgtctttaaaatttatttacttttaattgtagacaggttcgaacacatgcaaaaatctaacaagtccacatgaacccatcacttagtgtcaactcatagcctgtcttgttttacatacactcttgttccctgcctctttatccttttatttttttctctattatttaaaaaataattctaccatttgtaatttcatctgtacatacttcagtatgtatctctaaaaggtaagggttctttttcaaaaacgtaactataataccattatccacctagaaaaataaacaatgatgccttgatttcatcaaatattcagtactcttcaaatttggactacattttgagttaaagttgtataggttagaataatagtcataaagataaagctttttttttttttgagacagaatctcgctctgttctgttgcccaggctggagggcaatggcgtgatttcagctcactgcaagctccgcctcccgggttcacgccattctcctgcctcagcctcccgagtagctgggactacaggtgcccaccaccacacctggctaatttttttgtatttttagtagagacggggtttcaccatgttagccaggatggtctcgatctcctgacctcatgatctgcctgcctcagcctcccaaagtgctaggattacaggcgtgagccaccgcgcccagcaagctttttttaaaaaaataataaaaaatagagagagggtctcactatattgcccaggttgttcttgaactcctggcctcaagcaattctcctgtcacagcttcccaaagtgttgggattacaggcttgagccacattgcttggccaaacaaagttttaaattaccgtttttttcatgaggctaacttttaaggtcaatatttcataagcctttataaaatatttttgcagcctttaaggttttaactatgattcctgtgcctattaatatttaatatgttttatctcaaataagtagaggactgtgctggcaagttattaaatatttgaagcataatttttcattctgggatcccctatattgccttcccttacaaaggatttttgtgttttagttgtgtgtgtgtgtgtgtgtgtgtgtgtgtgtgtgtgtttaagcatcttgagcttctcgatataaatgctgtaacttagtgttttactttgtttttatttgatgagtataaatgattaaagttattacattttcacttttggagctgtatattcatcataaaaaagtcaattctgttattttgtagtcattaattttctgtagtacgtaaaagctgtacagcttgtcaagattcataggaaactaagactaactagttgagtatcttcatgaaattcagttgataggaaatatgtgggcttttactttgaggccaatagaagcttgttttgtacattttaattttcatttgatagttacattctctatttcttttatcttttgcaaaaaatctctattattcctggttttaatgacttgctcttgtataccagatatcctatcgaagtcaatgatctgtgggcatgtgccattaaaagttgctatttgtggccaggtgctgtggctcacccctgtaattccagcactttgaaaggctgaggcaggcggaccacctgaggtcaggagtttgaggctagcctggccaacatggtggaaaccctgtctctactgaaaatacaaaaatcagccaggtgtggtggcagacgcctgtaatcccagctacttgggagcctgaggcaggagaatcacttgaacctgggaggcggagtttgcagtgagctgagattatgccaccgcactccagcctgggcaacagagtgagactctgactcaaaaaaaaaaaaaaaaggtgctatttgtcagttgtttatttctcaatgtttataggtgtgaacagttttgtgatagtgttcttataaattttagatcattgcttttaaaccctgatatatcataatttcttgttttggccttactggagaaagaattgtttgtttttcctttatgttctttccgagctacctgtggtagaggtttttgataataggcagtggttttttattggaaccattttaaaagggaatcctttttaaatgtggcagaacttttctttttctgaatgtgttgagccacatttctcagagtagtgggaagatctgaatttatcatttgaaattttaagtattatgctaacatcgggaaagtggctaacaaatgtcagtgggatgtttgctcccacatgaaatgatctgctgcggactgttgtgctttttgagtgctatttaatgcttatatttgggggagtgttgatggcttgttgtcagcttcatcttttgctcctgtttgctttattacatcttttatagtttgggaaaccagatgattatattggttgaatgttaaaatgtgtgtaaatgggccttgtatgaggttcatggctattagcaagggatgtgaacatctattgaatttttttttcctgcccagaggcctttgttgatttccacgtttcacatgtgatttgcctcataaatgacttcttgggtaaatgtgatattataactatttggtttattttttttaaataggaaaaaaattaagcacaaggcaaatattggaagtttagttaatgtctattttatatttatgaattaagctattttcgaatcttcatgaaactgtaagtactttttttccgcttatagtttattctccagatatgccttcacggcttccaattcaagacatatttgctggactggttacaagtattggcactgcaatacgatattggtttcattatacacttgtggcctttgcatggttgggagttgttcctcttacagcatgtgagtattcatgcctctgattggagttatttaaacattgcataactacttaatattataaagcaatattgcatcatattattatttgactgatgtttagttatttgatgtcagagtgtcatgtattaggaaagccttacttagaagatgttcatcggaactaagaatgagtttaacaggtcagttttttgagtgaatgtgggaaagaacacagcatacagaatggctaaccatgaaagttcatgaaagcgttgaaaaaatcaaatcaaatcataattagatatgaagtatgctagagctttcaagggctacaaaagacggccgggcgcggtggcttatgcctgtaatcccagcacttcaggaggccgaggcaggcggatcacgaggtcaggagtttgagactagcctggccaacatggagactgaggcaggagaattgcttaaacccaggaggcggaggttgcagtgaactgagatcgcaccactgcactccagcttgggcaacagagcaagactttgtctcgcaaaaaaaaaaaaaaaaggactgcaaaagatgaattcttttgggattctgcaaccctcctttaaaaaaatactcacatggccaggcgtggtgactcacgcctgtaatcccagcactttgggaggccgaggtgggagcatcacttgaggtcaggagtttgagtccagctgaccaacaaggtgaaaccctagctctactgaaaatacaaaaattagccgggtgtggtggtgtgtgcctgtaatctcagctactcaggaggctgagacaggagaatcacttgaacctgggaggcagaggtttcagtgagctgagatcatgccactgcattccagcctgggcaacggagtgagactttgcctcaataaaatacaaataaaatttaaaaatactcatacatgtaatggtcataaataattgggaggcttatctttcagatataggaggctctttgggagggtggtatactaatcaacccccctaatcaatccaaagaatcctcttggattctttgttgttcttatagacatggagagaagtacatagtatatgggaggcagagtatatagataagattcattagagttaaactaaatgtttaattagtataattgatatcttcatgtctccttaaaatatgataaaataatcttgattacctatggaaatgaaattcttggaagataccaactagcagaatataggtactgttgaagagtgagttagctagaaaatgtatcaaggaattctcccaggatgaaactcagagggacaaatagttacaagtatgagaaataaatattgacaaatggaggctagtctagtctgtctagtaagtagttccacaaggtaaaagagataatggagatgaggaaacaattggtgtcttttagattgaacgagaaagctgaccatggtaaaggaaaagtctcatgaacctagacatattctcaagttttctggagctgggtagggtggcgatggtgatagaggtatagagattgtatgcttccagattatcctacaaagtaaagaaaatcagagtggcatcagacttaaaattagcaatgttgaatgctagaagacaatggaaactcaaaatttgatgtttttgaacctaaaattccctttctgcaaattactctcagattgaaggacaaactacagatgtttcaatggatgtgagggattggaaagtttactaccttaaacctttttgaaaaaacaggatatactttactaaatgagcaaggaatcagagagaaagatgtgagatacaaagaagtgtttcatatagctaagtctcaattgttaatctgcaataattaatagtttttgggtaacagcctggaactaaaattccagatgatcttaacgtgggagaaattgtgacgggaagatagaaattaaagcttttaaaattgcttatctcatttgtggggagattatagatgttctagatgtaggtagaaaaatacagcataactgtgcattaaaaatgtggactagacttataactacccagaactggactcaaaactacattgttacattattaatgacaaaagtgccaccacagatcggtggcaaaaagatggtcttttcagtaaatggtatggcagcaatcagatggccgtacagaaaaaaagaatcatatcattacctcaacctaacacagaaattaatttgagatgaatttaaaagcctgaatgtgaaagttaaaaagaaacttctaaaataaaatacaggagaataagcataaaacaaaatattagtaaattgaacataattaaagttaaaaacttctcttcatccttagacacttttaagaataaaaggcaattgaattctggcactcaaaaaaaaaaagaaaattgaaagccatggagtgagagaagatatttgcagtacccatagccaacaaaggacttgtatctagagtatataaatcaataacaaaaaggcaaacacatcccaattaagcagtggacagaattttgaacaggtatttctggaaaaatagctaaatatactaagctctccgtatctgtgggttctgcaatgctgactgtagaatgtgagcatctgtttattttgttattgaggagagtcctggaacccattccccatggataccaagggatgacagtagccaataaacacatgaaaaactgctcagcatcattagagaaatgcacaaggagggtgactaaaaataaaaagagtagacagtgccaaatgttgctcaggacatagagcatctggaacacgtatacagtgatcaagggggagcgcatatgttataaccactttagaaaactggcagtatctactgatgctaaatattacaaataccttatgatctagcagttccattcttgggaatataactaacagaacaagaactttctgttcactaaaggacatatgtataagaatgaccacagcagttttattaatagtacttaaaaactgatatcagtcaaatgcctattaatagtagaatggatacatcgtggtttattcatgcaacggaatactacatagcagtgaaaaaagagctaactattgtgacatggaataacatggattaattttgcttctttgacaaaaacaagccaggcacaaaatcgtatgattgcatgtgtgtgaaattttaaaacaggttacattcatctatagtggtagagatctgaatagtggttaccttttgcaggggctgttgcctgggaagaagcttgagggagccttctggggagctggaagtgttgaacatcttgatttgggtggtagttaccaaagatatacatattttaagaattcacccatctgtacacttaagatttatgtaaaatatactttaataaagacataacaaaactcaagggcaagtgctagaagaatagaaataggatgagtgggaaacagcaaataaaatttggaaatttcaaacaaaggcaggaaagaaaggaagggaatgcagaggaaggaagtagggaaataaaattaaatacatctgtaatcataagggtttagatttctctgttacgagagagcttcatagatgtgtaggtataaaacttgcactactacaagagataaatacaaagcagcacaggttaatgctaaagagatacaaaaatagttttgttagcaaatggctaacaaaaagccagagcaatattaatcagccagttatcattcaaatgcattaaatgggacaaagcattatatttcatattaataaaaggcataatccactaagaaaatagaattaaagaacttttatacaccagaaagctgggccttgaaatatgtaaagcattcacagtcatagtgaaagacttaacatgcctctttgaaatcagtagatgaaataggcaaaagtaaggacttacaagatttaacagttattaatcacaagcttgatttctgttctaatttgtttatatacagatacacacaatttaaattacatcacacgatacatattctgtaacttttctctagcttagcatcgtatcctggtggtctttccatgtacgtgagtgttgtgctgtcttatttttttttttttagcgatacacagcactctgtagtaagaaggcctgttgcacatgaatccatttacctatctaaacatttggtttgtcagttttacattgttacaagcatacttgtctgagtattttataaacatgtaagtaatttttattacagaaaatcttttcctacctttccattttgacttggttttgaaaacagccattgaagtcactgaaaatctgattggaagtctccgatacaaggctatatagggaatgcttaagctaatacacaaatactggtttgaaagaaagcctcaggtttttattcttgtgccccattttcaaatctgtggtctgttatctcattctgtctagaattctgctttcctgactaaaagactttctgccttgatagcagttcgttcacccatactttgtctttctctaaatggccagaatttagaataattatattctgtattttagaggacctgtgaatctgtgcttttaaaatattggttgtcaggttgccatttatggcattgcagtacatactctactgaaaaattctcttaatttcaaagacttatacctccaaaactgaaaccttttattgtcatgagcagacttaatgaattttggaattctagaatttaaaaaattctttatattataattttggagatctttactttagatttttcttttcaaacatctaagctcattcaataaaaaaaagcaactaaacctagagagaatctaagtgctaaacatgattgtgtaacatttactcttcattgtcactatatttgtgcttgactgtgtttttaaaaatttaatattttgagacttaggcttgtaaagactaaatgtttatttcagtggcatttgtggcgttccactttacctctgctttcttgagcagctatgtgaattcatgatgcgagttgtgactgtgtgccatcatgctctttttcggtaggccgcatctacaagtgcttgtttactggctccgtgagctcactactgacgctgccattagatatgctgtcaacgtgagtattgaacctctgtgacgaatgttgcatgatgtagatgatgcttgcttttttccttgcatatttattttattataatttgtaaattcttttgttttgagaacaataatttatgtctattacactaacagttatagctgcagtagaagtagctgataaatgtaaatgacacttcttttaaaacatacctgttttatgggactgttttgtaatgatgggatgacttttctttctttcttttttttttttttgagatggagtcttgttctgttgtccaggctggagtataatggtgcgatctcggctcactgcaacctccgcctcctgagttcaagcgattctcttgcctcagcctccagagtagctgggattacaggcactcgccagcatgcctggctaatttttgtatttttagtagagacagggtttcaccatgttggtcactctggtctcgaactcctgacctcaggtgatccacccgcttcgggctcccaaagtgctgggattacaggcgtgagccaccgcgcccgtccgggatgactttttaaataggctgtcacgcagtttgagatacatactactgtcttatgttcacaaaagtttttttgttttgtttttttaaatggagcctcgctctattacctggggtagggtgcagtggtgtgatctctgctcactgcaacttctgccttctgggtctcctacttcagcctcctgaatagctgggattacaagcatgtggcagcaagccaggctaatattttgtatttttagtagagatggggtttcaccatgttagccaggctcgtctcaaactcctaacctcaagtaatctgcctgcctcggcctctcaaagtgctggggttacaggcatgagtcactgtgcttgcccaagagttcgttttaacatgtgtttttaacatacacatttgaactcaaatttattttttaaatgttttccatgattattagaatataaatgctaagaacttgcctgtagttactttactatatcttgatattaagcattgttgcttgccttatattggcaggcttctttttccctctcacctgataggcttgagggtcacctgaattgctttcattagactactcattgactccagaggaccactggaagcctagtggggctagtcaaaataaattataaacatggcttggttttagctgtcttttacagtttgaaaaattgagccagtttttctgatagcagttgtgaccaaactactttttttctgagtaatgttttacactctctatagaattttttttctgtgaaattttactttaaatttccttaatgtcttaccagtttctatgtattctgtagctcagtaattgaggtcatgtctaggtgcactgtatcagttatctattgctgcaaaacaaactgtcccaaaccttagtggcttaaaacagctaccattttatttgcttataattctggggtcagcagtttgggctgggctcagctgagcttttcatctattgggcttgcctaggtcactcagctgttttactgggacttaatgatctaagatggtttgtctgagatgccttggttcttctctttgtggcctcttatcttctaaaaggctagtagggcttctttacatggtagtctcagggcagcattctaaaagggcaagagaagaagcttgcaggccctcctctgggctctggaacttgggcagcatcgcctctgtccaggattcacaaaaccagcccagattaaaggagtaaggaaaaaggactccagagtttgtcaccaaatgtttaaaatctgtaacaaacagttaggattattgctgatagcaaggaagatgtaaaggggatattttggtcccaacctttcagaatttagtagcctggagagttccttactaaggtggtagttaggattcctcttttgattcaggacatattgcagactatattttcctagaggccataccagtttagtttaagtttggagctgctgggtcaaggtctaccagattgacccttctcaggttttctatggaggaaaaaagtgattccattaaaataatggattttccaatggctaagagtccagaggcttttgagttatctgtgaataattctgaaatcataaacatggactagggaaggaaagataagcctcttaagaaaggaaaaggacaaaatggtcttcagtatcatgatatttgatgcattttcttgtatgattactaaaggaaccatactttgcctttctgaatttgttgagaaactaatacacttttggtatgattgcagttagcatcaaaacttggtttgctttctaaatgaaaaatttctttttttttgagatggagtctcactctgtacccatgctggagtgcggtggctcaatcttggcttactgcaaccccccgcctcctgggttcaagcgattatcctgcctcagcctcccgagtagctggaattataggtgcacaccatcatgcctggctaatttttgtatttttagtacagatggggtttcaccatgttggccaggctggtctcaactcctgacctcaagtgatccacctgccttggcctcccaaagtgctgggattacaggcatgagctactgcacctggccaagtgacaaacttctataaaatttataatagacctctttgtcttacatatggcatactgaatatctctcaaccttcatttctttatgttgtcattagacttatctggaggagcttctcctcttttctgatttgatgattctattaatttgtgtgggttcaggtgtcagctaatcaagtttttaaacatgtgtaaaataaagatacagaaactcttagagttggacagagtttttaacctttggtaaattacataaatttaatgcatggcctttgtcaagtgttagactgcttttgtctttttttgcgtgctgcctttctgtttctaggccattttcaaaagataggctatggataggtaatttccatatagttctgatggtatttgatgcctaaataaaatacataatacaagtatgtaaatatgtataggttctcttgcaagtagaatttcaccataatcacaaatagttcttttggagaaacttgagattttcatccaaaaaattatgatttattcttctggctgttttttttttttctgagactttagtataagaaaattttttacctttgttttcctaattttaagtcttctttggagtaattatatgtacttttttttttaatagggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggtaactcccctaccccaaaattgattttacttaggtaggtcatgagaattattgtttctctctgagactcaaactcttgacttccatgtccctcataaacattcttttgttattacaaaggagggcagcggaaaggtttgggtgaagatgaagagagatgtgaaaaatcaagaaagtggtattacgactttgcctcttaattttctagttagagtgggaacagcgttggggggtatactgaagtccatgtacacagtcttacccactgagcagaaatttgaaaacatttcctcaagtgtttgatgacagagcatgtatgtatatatgtatgtacatttttttaaaaatgtattttcatccctgatgctgtcaataaagacaaaggctgtcttataaaaaggactacagaatgtttttaagagagccagatttgttaaccattttctataatgctttgtgaactgttaatccgctaaattatactgaatgaatatgtacacgtgttatgaagtgaggttgtgttcttatatactaaaattgatcccacatcagatacatttaaaaaagatgtctttgaaaggttttgtttttaaaaagaatttagtagagtttatatttgttttctagttttttgtttgttttggttttttgagattggctcttgctctgtcactcaggctggagggcagtggcatgatcacacctaactgcagcctcacaacctctgggctcaagagatcctccttcctcagcctcctgagtagctgggactataggcgcaaaccaccatgcctggctaactttttaatttaagtacagatagggtcttgctgtgctggccaggctggtcttgaactcttgagctcaagcaatctgcctgcctcagcctcccaaagtgctaggattacaggcatgagccactacacctggcctaggttttttttttttttttttttttttttttagcaggaataatgtgatttggaaacagagcaaaacagacaagtggatctaaatttctgggcttttctgtgattttaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccagggtaatggctgcttgtgtgtcctcactcttcagcactgcaaatctgttctcaacttgcattgaggaaaagggctggcgttttcaaatttttaatgttgtgaagttctatttctaacttatttttactttattttggcaaactggcatttatggatgtacatatgcataaatatgtttttttctatgaaacagggcatgttttgtgttttaaaatcctttttacacaggccttttttttttttttgggagactgagtctcgctctgtcgcccaggctggagtgcagtggcgctatctcggctcactgcaagctccgcctcctgggttcacgccattctccggcctcagcctcccgagtagctgggacaacaggcgctcgccaccacgcccggctaatattttgtatttttagtagagacggggtttcaccgtgttaccagtatggtctcgatctcctgaccttgtgagccgcccatctcggcctccaaagtgctgggattacaggcgtgagccactgcgcccggcctacacaggacttttttaataggatagataggaagaaactattttttaagttggattaggtactactttttttaaataaaggactttgatacagattcacctcattcatttgcttctctctttccatgtcccttgagtcagtgcaatttctaagattgaaaaagaatcttgaagtttatactgcagacaagatgccatctaaataaatcaacgtctcgttttctagcagtgtaaactctagaatgtaaaataagatccaagacaggagatgggtagatcacctgaggtcaggagtttgagaccagcttggccaacatggtgaaaccccatctctcctaaaaatacaaaaattagctgggtgtggtggcgcacgcctgtaatcccatctacttgggaggctgagataggagaatcacttgaacccaggaggcagaggttgcagggagctgagatcatgccactgcactccagcctgggtgacacagcaagattccgtctcaagaaaaaaaaaaaaagatccaagacagggtctaccagtcagctgttggtcactcacttcccctcctccctcccaccacagttttcctgtcaagctttgcactatctctagttctacttggcagcctgatatttttgtgtctctttgtgtcacgtactctgttagacactgagcatataactgtgaccaaaacattaggctgctgcattcctggagtttctggtttagtgaaaaagtaggaaatacacgtcatgatgagtgttgtgcgggttgctctgaggatgctgttggggagagacctattaatttacctttttttttgagacaaggttttgcctttgagccaaggtcacctgggagggagtacagtggcaggaacacagctcactgcagccttgaccttttgggctcaagtgatcctcccacctcagctccccaagtagctgggaccacagatgtgtgccatcatgcccagctaatttagtttttgtttttgttttcttggtagagatgggttctccctgttgtcctggctggtcttgaactcctgggctcaagtgatcctcctgcctcagcctcccaaagtgctgagattataggcatgagccattgtgcccagcctagacctattttgaataaggttttccaggtagctcagagtacctggtatttgagctgagacctctgaaggatgagaaaaagcgacttgtgtaatggtaacagggggcctttgcagggggaggtcagaggctctgagaatacagcctgctgctacccttgagtctggccgttatttctctctcttgatctaatacagtagctcctaactattctttctccttccgttcttgctccacatagttcatattactctgctgcctttaaatcttttagtagttttcccattactaaagaataaaatccagactccacattcctcttgtatgatctgatttctgtctttctactacccatatcattagtcagaatgtccttagttccctggcttccttacttttctcaaatctgccagattctttcctggcttagagctattgaattcctctctttcagataaccttatttattccttttctagcatttatctcaatctaggattaccttactttatatgtattatttatttatatgtatgtttttattcttatttgttccctgacaagcaaatactcagtatggaaatgtggcttagcttctcaacaacagcttacaaagtactaaattttactatttttagtgcattctattttttttattatttattatttttacttcaagtaatctttaaattgcaattatattttcagatgacatgaattggaatgctttagaatgggaccgagctgctgaagagcttacatgggaaagagtaagacctttttctgtcaagtatcctggtgttttaatcctaaaatatattttaaactttggtgtatttagatgtatacactaatgttatcgttacagttgatgaaaagttactagaattttcattcctagtgaaagttaagtgatatattgtttatggtcaaaatattgtgatgttggtggctttttttggtcttacaaaatcttgctccatttaggaaatgttttacctgaaattgtggacttttgaaaaacaaaataacaatttaaatttaagtagtattttcatgcttcagttgacaaaataatacagttttattatgaagtaatcttaattagctgtatatcttgagtaacaaatccaagacggaattgttttagactttataaatcatgtaattttgaataaaaggagacccaaaatataaaactctcattcagaaacagaattttttttattttctgaaaatgataggaagtattggaaagtataggaagtgggtgaggactgtgtttaaagatattgaaaggaaaatgaggcttttcataaattagaatagaaagttctgttgcatcttaaattaatgcttatcgtttttgtttattttagatgctaggacttgatggatcactagtttttctggtaagtaaaactaattttttttttttttttttgagacggaatctcactctgtcacccaggctggactgcagtggcgtgatcttggctcactgcaacctccgtctcctgggttcatgccattctcctgcctcagctttccaggtagctgggactacaggtgcccgccaccatgcccggctaattttttgtatttttagtagagatggggtttcaccatgttagccaggatggtctcgatctcctgacctcgtgatctgcccgcctcggcctccccaagtgctgggattacaggcgtgagccaccgcgcccggccaaaactaattctttctagtaacagaattggagttgtcttagtgattcagaaacttcacatttatagtatgtagtaaaggtcaagatgccctttggcttttaattactttatatgttgaagattgtatgtttagtgtgctgaaaatattgaaaaagcataaaggtaatatttttaaaaaattgttaaatatttgatttttagcaaagaaaataaaccccaaagttaatggtagttaaaaagaacttggtcttcttttaaagtttcatcttgcagtgtttattgcctgtactggtggaagcaaagcagttttccctattttcacagtgagacaccccaggctgatgttaggttttcctgtttgctgaaccccacctgtctttacctaggaactttgccatattagtaaagattgcaagtctaaggtgaggagcaattctttaaagaacttgttctttaaagaagaaatggtgctgttttcaggtcctgtaatatgaagttatttgccatttgggatttttaaatagcttaagatgactttggctgcaggtagcagaacccctgctggttggaacattaatttaacaggaagtccagaggaagaatgggcttgaggttgcttgatccataggcccaacaatgtcatcagagaccgagatatctccatctgtctcctttgctgtcctcagtgttggccttctcctcaggctggctccagatgttaaccagaagaggatgttgaatttagcagttgtgtaggtttttaggaacatatctggtataattccacagtttagtgggaatgtgatattaatgagcttctagtcatggtttgatcacagtcagtatagaaagcattatttggccacatactgatttatattccttaccccatcagttcctcataaatgaaggacagaagtcgttgaggtagtggtggtgactcaaactcatttgaattattggaaaaaccttcgacaggatgaattcattattttagtaaaaaatatttaatatgtatagtgtgccagctattgtgctaggcactggggaattcagtgcctatgaattcaatgcctatgaatgagacagggtccctgttctcaaagatgctctatagtgtggtagagagaaatgaacatgtaaacaaggaatgttttggagtctcagtgacaaaaagtgtgcataggacacaagaggggcacaaaagagggtttgattaggtctttcttagtggaatggagtttgtcagcaggagattttccgcgaagataacagaggttgaagtataaaatgtgttggggatagggaaaatttaggagcccttaaggcagagaggttgaaaaaattgagcccacatggtgagaagaaatgtagtagtcattcacaaactaattacccttctttctggttggatttgtggaagattaggggacctgaacagagaaatcctttttttagacaaaagatctttggacggatcatttaacttgatggttgcggggaaggttgtgggcatgaatgaatggacttgggcagtctggtcagtgtcagcatggggcatagctaaggtgtgtgtaacatggctgaaggaataggcagatagctgtcgccttagaggtgacagtatgtaactgtgggaggtgaccagatggtcaggtgagacaggacaaagaaagtcagggcaccatagggagtggagggaccagaggagatcaagctagagttttccaaaggagtggtagccaggcaatagtgaccttgtaggtgtcaagaaggcagattggacgttgaaagaaacactgcagttgacgttaacatgatgtttacaattaatttggctttcaaatttttctccatttgaaatttttagtgtcatttgatttaaatgaaatctggtggttatgaaaatctatgtaatttgtcgtagattatttctaaaaaggaagtgtttataaatgaatttgttttttgtacatgtaacatttttgagttttattaggcttagttgtatgagctatctaatgaaaaatgaaagttacatattatgtctagattgaaatcccaaaacaatagagggaaaatttcaatcttagctgtttttactatttggctctagctaaataagtggaatagtccaattaaacatacattaagtatgaattgaatatgctttattgatgcttttttcctttaggaacatgtcttctgggtggtatctttaaatacactgttcattcttgtttttggtaagttgtgtttgtgctttttttttttatagtattatggtaggaatttagttttgtaggagccttgttataggtttattattattttttaacatagaaataaatactaagcagtatatgaaaatagtttcagatacaaaccctgtatagataggccccagacagacagatactttcctaagcagcagtgactgcagttacctacctatctctccctctgttgggcatttctgggttttttttttgtagaagctggttttagaccgacttgaaaatatacagtttcccatttctggaattagttttatgctgattgtgtgtgctcttccctatggtggaatatcttgttttcatctgtcaaaatcctgaccattgccttctagagatcttgacttgggagctgttaccagagctgagtgtaggcttgtgggaagacagtaagccttccccaaatgtgagcaccccttagaaccagattccagcacatacaaaatcacttccaagcacttctgcgagggcagctgtgaggattctttgacagcacacaatggtcccttccattgggactaattagagaaagaaaggcaaggttgaggagacactgttgacagaggtttttctcctttccagaagaggtaaggaaaactaagttgagtaaaccaaggccttagaattcagtttctgtatctcttaggggtgaggacgtagagtctgatggaatggggttattgttaggtgtcctatgatttgtgtctcagagacttcaggcaacatatccctatatagggataatctatgagaaattccttccttagtacatgggatttacccctcagctctgctgaagaggatgagtagagatttcccaaggcttcttccaccaaattccaagttatttgctctgttgaggactacattgtgacgtgtaaagcagacgtctttaataagaagccatgtggtgtaaggggctttgaatatttggactgaggatgagaccaaaaattgatttctgtgtattatctgtaaaagaggaagataaatttacttgtattttgttaacaaagtatttcggatacttccattgatttcttaatttttagtagatactcacaaaggtgcagatttattaggattttttgttccctttacatgtgggggtgtctgtatgttatcctgcatttatttttcattatgtaaaataattcatatatagactgtgaaactgttatgatcttgactgcattttttttttttgagagaaaaaatgatctatagatttaagtctttactcttgcagaaaagcttaatgctaaattaatgtttggagaaccaggtcacatttaaaacatgaattatacaaataagaactctgatttatagaaatcaaatctaagtaaagctttttctaatccaacctcctgagcttatattgcgaaaagaattttcttagtaaacttatgttttattatatagttagaatcttttggaatcttttgaaatgaaacaagttttcttccattaggaacatactttttcttttaatcattgggattaaacaccctcctgtttttttcttgcatgggttgctctgttggaagttttctacaggcagttttttggctcttgtggtcatatgctttgcagaaatataatttgacaaagctgtggtcttccactagaaggtgacaatcctgagaaattgtccttaatttcaggatgcctttccattagtttgtgtgtaatgggatggaaattgattgttgcaactggtatttaaggttaataattatttaatacatctgctaatagagttaaaacttgcccctcccaggggcctagttgagtcatcttcagactgggatatgagagcaaaataggcaaaattcaacatacagtttttttccttaccttattaaatttcttctgctttatattacacacaatatgttagtaaactaatacgtatatataatttataaataaatttaaatatattggaaatacatgttcaaaaatattcttacccatgaaatagtcagaaagggttagaggccagatccctagtaggttcactctgacttctgtcttcatgattgagtttcccactcccctggtaatctactgcgctgtcgatttatttctaccataaagaaaagataactatattttattattaggaatgaagtaaaatttagccagaaagacttgaggaaaaagaagactataaaaattctcttgctataaaggttttaaaaatactttcatacttagctataatgccattatctcaccttacaaaattactagaatttggtatttcctaataatccatcatattcaaactctctgggttgtcccttacataccattttgcagttggtttctttgaatgaagacccaaataaggtccacatattacttttagttgttaagttataagttattagtcttttaatctagagtactcttctctttgcttcccccaactcaccctatttggccattgatttgttgctgggattaggttaactgttcttgcagcatgtcatgttttacatctgtccatctgcttcctggatgtcctctgcctttatcctttgtctcccatatttctcttaaactggaagtcagatctaagggccttattagattcaggttgaatacatctgggacaaatccatcactggtcacactgtgcctattaatagtatatgtgaggagctgagatacatgatgttggattatccacttttatcactggattcagctgatatcaacctgggcctctaatcttaggttttgtttttccctttaccattataaaataatctgttgggagtgatattttaaacagtcattttttatatttattggctgacttttctgaaagaagaagaaattcttatcaatttgggactattcagtcaacccaaacctgtctgtccggggcaagtaggacagatgctcatatttttcccattaattttggttttcagaataaggaattggtgtattaactattcacatgggtgtgctaactgcttccaaaacatcaaagtgttttctttgatgttgctttttctcttttcgtgattattattttggacttttccttttttgagcatcataaactcatggatttgtgtatgttcagtgtttttccatcagttttggtcattattctttttgatgctcatattatcctctctttggcctgttttcacaatggtttctgtgttgatttggcatggccctattagaccttaatagctttgttgttctctagttacagagaatgtcctaggcagtgtatttttagcctagttctggaatctttcatttctccaagaagccctagttccttttagtggggaattgtagtaggagtgttcattgttttgatgtcggagttttcatggaattttttccccctttttagcattttgcccttaccatattggtcatttctcccttgttggtttgggatttgaagaacacgtgagtataatacttttacaaagttactttcattcattactcccaaatgtgattattaataaaatagtattctaaagagttacatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatgtatcctttaatgaaccaacttgggtgtacactaatattattcataccaaagaactcttcattaatggcgaaacttgtctatccttgtcctcttagtaaaagttgtaggtatttgcagtaagggtcagtgtggacaaaatgtgaaataaattaattctgtcaaaaaatactaaatgttggctaagtagttacctgtttcattgtacctttaaatactcagtttttccttgacctgatgctgtagggcttggcaactcttgtgaaatttcatagatctcgtcgcttactgggagtctgctatattgttgttaaggtaattcctgttataacttaaaattggaaatgatttctcctacatttgggtgatactgatgacctttattttcacttaaggtctctttgttagtggtggtagaaattggagtattccctctcatttgtggttggtggctggatatctgttccttggtaagttgagtattcattattgtataatagcataatttaagggcttcaaaagaggaagtcttcagcatgtattctttttaaaggaaagcaaatatttgataatttgcttattcttttggcatgtgtatcagtataggatcttaatgttaatttttcttgagtacctgagtttttgaggctttgtgcaaatttttgatgtcaggatagtttgggtggaatctttctaatagtggaggattttattgcccattttgctgtcgtaaatttgtgtagataatgccaagacattatatacatagagaataatttgataaggaaactgtctttgtagtaataaatttaaccctaatcatttgatttaactaatatgctcagtcttgattatactctttaattgctgttagtgataatcagtttttgattgtttcaaaaatattttatgtgtagaaaagctgcctttggttctgagataacatttaccctcccataccttacttttaaaacttctcaagaatgcagacctataaccaagaaaattttttacattcatcaaaaatagttctttaatagaatcagtattaataaagcttttactaattggtttatcattctttatatttgaagcagtagccaatcttgtatatagttctgtgacaccgtggaatgacattaagtgaactgcagttctaggaattgttccttgcatgcatattgattatttatttcctagaagatgaaaatgttaacttggcaaatgtagggggcacagatttctcttacctgtcctcttttgtctcaggaaatgtttgatgctactctgaaagatcgagaactgagctttcagtcggctccaggtactaccatgtttctgcattggctagtgggaatggtatatgtcttctactttgcctccttcattctactactgagagaggtaagtccacagggaaatgctgatgctgtacatttataaaaaggacttttgctttcaccaccagtcatgtctcaaaggctatgatgatttcctacctaaatcatattctctactattttattctaagagggaataacttataggggactttgacttaattactttaaactgtttcagttgtttgtctccataattggcaagttttaatatttctgtctgagtttgaaagacgattcaactgaggaaaaagataagagtactcattttgtcacacttcgtatatactttagccatcctctaatacagactcttggaattttgtatgatgtgagtgtgtctcagacttcaaggaactgtactgctggaaataaccaaaaggatatggttttgcaggatcagacatgtaaaatcattttgatttaggcgccttaagtatagaattacaatgagggtcctttatgattccagttcactggcctgatggattacctttatttatttatttatttatttatttatttatttatttatttatttacttatttactttttgatactgagtcttgctctgttgcccaggctggaatgtagtgccatgatcttggaacctccacctcccaagttcaagtgattctcctgcttgaacctcccaagtagctgggactgcaggcacccaccaccatgcccggctaatttttgtatttttagtagagacagggtttcaccatgttggccaggctgttcttgaactcctgacctcaaatgatccacccaccttggcctcccaaagtgctgggattacaggtgtgagccactgtgcctggcctgatacctttattagttctatgtttctaatctggttcttagtgatttgaagatgatgaaagcagttgagtatttgattagtgtacatctcaagctcagtcattccccaaatactgaatggtcactgtgtgccggacactatactgcattctggggtttcagtgagaaacaaaggcacaattcctgttctcctcgattttatagcctgaaaatgaatacagcattgaaaatgttggtttacacggagacgggtgatggagatgtgcagggtgtggaggaccaggttgacaattccagtgagaagggaacacaaaagcacaaaggctgaatgctgctcttggtgtactttgttctttgaaagatttgaggaagaggaggaggggtcagggaccaaagcattctcctgaatcatacggtataatttcagtaaattctcttggtaactaaagctttcattctttctttgaaacaactgattgagaactaaagcaagtacagaaatgtgtttcttaaaaatgtaattatatgtgaactccagattacttcattaagtgaataaaatgctttataatgatttctttcattttatcagtgtggtggtttttgttgatataaaattttaatatgtggaacttaggcagaaccttagaaatcacacactgtaaccccttgtttaggagatggagaatagaagtttgggcagattagatgcgttacacagagggtaactcagtgagtttggaccacatagaactagtacccagactcctcctttaccccatcacctgcagcctcttgggtgatgattttcatttacagggggaaggcaaatcagaccgtctatttagtacatttataaattgcaacataacccttttacgatagtaatggttgtatttatttttcgtctcagaggtctagatttcttgacacattggacccaatgaatgttttttttttcccccgcccctagtgaatgatgatgtcaaaggacatcatcagacacagggtagttttcataaagattctggtttaggaacttactttcctaagaataccatgtacattttctggggcccactttagatgccagaataattctaagtgcttatctttctgttaatgttttagctcatatatagaatttgaagacattggtgaatattcatagtatttaaaatatatttgcaggtacttcgacctggtgtcctgtggtttctaaggaatttgaatgatccagatttcaatccagtacaggaaatgatccatttgccaatatataggcatctccgaagatttattttgtcagtggtaagaagatgtttccattgttttttttttttgaattaattgtgctaacctatagttttgtttaggtttttttttccagttctcaagcaggctgatagagtatattgaataatatatttatctaagcctgtggtattcagttgtcaagtagctgtgttattggttactttgttaaaataaatatgtaaaaagatatttactaaaaggaagatacttccttgttccatagtagtataattcaggggtccctagcccccatgttttggctgggtactggtgcatgtcccgttaggaatggccgcacagcaggagatgggcagcggtcaagcaagcattaccacctgagctccacctcctgtcagatcagccttggcgttagattctcatgggagcgggaaccctattgggaactgcgagtgcgagggatccagattgtgtgctcattatgagaatctaatgcctgatgatctgaagcagaacagtttcatcctgaaatcccgttgaaaactgttttccatgaaactggtccctgatgccaaaatggttggggaccactggtatgattgattgctaaattacggttgtctgaattacgtttaatttgcattgaagcaatggagacttactactggcttgtaaattaaactcttaacagaagcatgtcaaagtttccccacccagaagaagaaattacatagttaaatctaatttctttcttttttttttttttgagatggagttttggtctgtcacccatgttagagtgcggtggtatgatcttggctcactgcaaccttcacctccctgtttcaagcaattgttgtgactcagcctcccaagtagctgggattacaggcgcccaccaccaagctcagctaatttttgtatttttagtagatgcggggtttcactatgttggccaggttggtctcgaactcctgacatagtgattcgcccacctcagcctcccaaagtgctgggattacctcacccagccgtaaatctaagtttttctaaaataaaattcttaaagtaacattatgtcctttgaaagcttttgtagccattaacatggggcaagtcttagctggttacaagtgatttattaagttgcaggcatttctgcttcctcattttaagtttccagctcattccttaggtagcaagtggtgattatcctttgtggcttccgttttagcatttgtgtcctagatgggaggtccttacaggaagaggggcaggcatcttaggaaaacatttttatacaaaatgactcaaagataatgtgtagagtgggaaccgcttgggctttgagtagacacaggcctggactgcatattgcttgagtgtgctcagaagtctgcctgtcttgcacaggagtgattgactcttatagtggtgtcataccctgtttccttctgcagattgtctttggctccattgtcctcctgatgctttggcttcctatacgtataattaagagtgtgctgcctaattttcttccatacaatgtcatgctctacaggtaagttttaaaaatttagaatagctttactaatttatctctattagggatttgatgttcagattacattaaacatttaaaacatttcttatagttactggaaatcatctgacaattaaattttgctttattttacctttatttttattattttttaaattaaatttaatgtttaaaaaattttctggaccttttccactttgcataaattttgccttattttagatcagataaacattagtacttacattttgtaaaggaagatgtttattttttctgcgcataaagtatgcatttgcacaccattgaaatgttttaccatacctaatgagagtgtattagcatcatctttattttgaaaagcacattataaagaataaagccagagttgcacatttaattattaaaaatagggtacaaggcttgtagatggaacatcttttttgctttaaaaacttaagtgggctaaggccaggcgtggtggctcacgcctgtaatcccagcactttgggaagccgaggcaggcggatcacctgagattgggagtttgagaccagcgtgaccaacatggagaaaccctgtctctactaaaaatacaaaaaaattagccatgcgtggtggcgcatgcctgtaatcccaactactcgggaggctgaggcaggagaatcgcttgaacccaggaggcagaggttgcggtgagccgagatcgtgccattgcactcccacttgggcaacaagagtgaaactgcatccccccccccccaaaaaaaaaagccatccggaaacctcccactaccagtaatctttaccactcatcctatatgctctttagggatttgtattatccccacagtcattatcccaattgcaggcaaattggattatttcctcaagtttacttctaatgagtctttaaagtattgccaattctaatttcttaaaatctcttactaatctaactcgatttgccacttacttaatttaggccttcctcttgctctccattcatccgcaacacctctgcctctagattttctagaacttggattattttacccctgtgtttaaaagttggcagcacttcctctgtaatctatgtgatatatacaccatttagaatgagatgcaagacttggcataatctcatgttgctttttcagtgtcttgtctcagcattgactgacttcaattcttttaattgtgctacactgccattgaggctcccctgattacttagctgtttgtctttttctctctgtttacaatgacttgcttgtccacgtttgagtggcaagcatttgatattctttttaaaatccagattaaggtttttaaattttattttattttttatgagaaagagtctcgctctgtcacccaggctgtagtgcagtggtatgatcatggctcactgcagcctcaacctcctgggctcaagtgatcttcccacttcagcgtcccgggtagctgagactacaggcgcaagccaccacacctgcctaatttttgtattttttggggagaccgggttttaccatgttgcctgtgctggtcttgaattcctgagcttgaaccatctgcctgcctcagcctcccaaaatgttaggattacaggcatgagccactgtgcctggccatcattccatcctttaaaattgtcttcatcgttgtatttctttttatagcatttgttacattactttacaaatatgtattgttttatcccagatggcagaaatcatgtcttatttaggtctttttctctctgtctctctttttttaatttaaaaaaatattttgtggagacagggtctgactatattgcccaggctggtcttgaattcctggcctcaagcaatccttccactttggtcgcccaaagtgctgggattataggtgtgagccactgcgcccagcctcttatttggatcttaatgctttgcataggaacatgattgttcaaaaataaaaggtttactctacacatagtaaaatctcaaatttgtattttattaaattagaattggaaaatacttatatcctgattatttaaagtggcagaaaaaatgccagtaagggtatagaaagtgggcaggatggggttacaatttaggaatagtgactggtaaagacctgagggggtgacagttgaggaaagccctgaaggagttgagagagtgagccacgtggatccctgaaggcagaatattcttgcagaaagtaggtgcagtggcacccaggtctgtttgaggatctgcagggaggcaagtttgtctgtagtaggaggaggaaggcaaagaattggccctgaagtcagaaaggtcatggagagccacctcctagagagtcttacacgacataagcactttggcttttgcttgagtgaattgaggagctcttggaaagctttgagcaaaggagtgatctaacttaggtttaaagaggatcattctgactgctgtgatgagaggaaactgggttggagtggctaggtcagaaacaggaagccagctgggaggataatgcaatgatcctggtgagaggtgagggtggcagagatgaaggggaggtagcagtggaggccttgagaaatttttaggatattgttaaggtacagtcaaaaggattctctagctgtttggatgtgaggtgtcaaaggaaggagtgaccttttgtgtaacatgctactaatatagcaagtgaggagagaaccaagacctacccatcagtttagcaaaatgaaagtctttggtgacccttatcagaaacaatttggtggagtttgtggggaaagcctcactgagttggagagagaatgaaaggagaggtaataaagacagtaagtttattagattcttaagaagttgcgttgtaatcccattaaatagtagtcatatgcaaaatacaattcacattataaatcctgcctctttcagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctgtgagtatgggcagctgactccttggacatgcatgtcatttgtgactatggaataacctttctggaaaaagtatgttccatggcccactcaagaaaaattagttttaataagagacaatttagtaatatttgcaattgcatataatacttctaaatgaaatttttttttcttattgtccatcctttcatggagaatatatacatctttttgccctcttatagaagtttgctgctggtccagctttcatggagtaaatgtcttttttttttttagtgcattaaaaacaaaccagtttacctttatttagaccaactaacttacctttatttagtgctcataacctgggaaatgggttcttctcaaatttgatttctcaatcttctagtgaacatgttgcatttttttccccaagctttatatactctatatttatttaaaagttgaatctttaaaagtttttcagtttggcatcttgtaggtatcttaaaggtgaagtacagatttggttatatttgcttgaacatctgtcgtcctctaactgcttcctcccccagtctcatttctgacctaactgatttatagcttggaggttttacaaatttatagcttgtagctacatgttgcagtagtcatctgtagagaagataagaagtttttcttttcctcctgtagatccttaacaatattgtacattgtaagtatgtacttacaccttgtgcttgtaagtacttacctcttgtacttacaagtgtacttgtaagtatcttgtacattgtacttttttctttcagttactgatttcttctcagatactggctgaagaaaacgtaaaataggttgaatttatgggatatcctacaagttcattaacattagaaaggtttgatttaaagtgggtacaaacatttagaccaaaattaggtaataatgtggtgcacaaattctgtattatacattttctacccttagtagtaaatatgaagaaaatgagtgtcatgtctgccattttattgtgacctgaagtgagacttgttactgatgtaatttttgcacagggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcagggtaggtgctatacagacttaatcacatatagaggtttttttggtttttttgttctccaaattgctgttgagaattggtgctattagtatgcagtcctctgtgtagacatgttccacattttattaccctcattatgtaacgtaaatgattaggtaagtttatcaaattttagagataagtcaaagagttgggattccctgggctcttgctccctatttaagaggaaaagactctagagtaattaagaaactaacattattgatacatttcaacagtgtgtcaggaactagaatgggcatttggatgttttctcatttaatctccactcaaatactgcaaagtgtaggcgataatttcatgtttatagctaaggaaactgaaggcaatattggttaagaatgtgcctattacatgttcgttagcaagtgatcaatctttgtgcacctcagaattttgtcagaaatgtaagctgatgactgctatatgattacagtgaagtcatcatttatatcaagtctgttattttaaaatgccctttaataatgacatgggcttgtgagtctgatcattttaaaacttgggcaggttatttaacctctcagcctcacatttctttttttgtaaaaatagtcattattatacctttgtagattactgtgggtcacatgtgttcagtcattcagcaaacatgtcttaagtgtctatgattgatattttcagtgtctgtgaggatatagagagcatacgtggtctttgctcagaaagagcttacagtctactcagatgagaaagacagtggcagatttgagctctcatgctggtgtttacagtgggtgctgtgactccttcaatcaagaaccacttgttcttaatatggacccaaaggaatcttcctagaataggtggtgcctgaactgtcttaaacattgagagacctgtcagagagtgaaaaaaaggaagtgggaagggcattccaggaatatgtcaggactagggcacattaggcatggtgggcttagaattgcagataagagagttgtgttgttttgtttttgagacagggtcttgctctgttgcccaggcttggttgcagtgtgcgatcatggctcactgtagccttaacctcctgggttcaagcgatcctcctacctactcagccgtccgattagctgggaccatgggtgcatgccactacacctggctaatttttatattttttgttgaaatggagttttgctatgtagcccaggctgttctcaaactcctagttcaagcagtctgcctgcctcggcctcccaaagtactggaatacaggtgtaagccactgcggctggcctaattgaatatatttagagggtgaggtgtatgtccaggagaggtgaggaacaaggggagagatgaggggccatgggagtggtgagggataaggtggggaagaggtgagggacaagaggagtggtgggagataacgctcttgaatgggcaggaaccagataatggagcaccttgagcaccctctgcatgagtccacactcactgaattgttcttctgctcctttgtccccttgaggggcatatctctgttcctgattcagtggcttattctagaggactttgctgcataaccttgaggaaagcatgaaggtcatcttttcctttatctcttaatagcagatctcatagtcagctcccgtttttcccccttggtctttactcagctctctcgcctctccgcagacaaaaaaggccttctgagcaacagttactttctggccagatcagagacagactcaaaaaatgacttttcacacagttacagctgacaaagcctcagagtctcctgggttttgttatctgtccttttcgggcttcccaccagagctctgccctctggtcttgtggagatccacctggtaagctagcaggcaagctacagttgctgcctttctgctcagggaaactggtttcctcttctctgtgtgatcactttttatctgcacttctgtattagtctgttttcacactgctaataaataatctgagactgggtaatttataaaggaacgaggtttaattgactcatagcattcacatggctggggaggcctcacaatcatggtggaaggtgaatgatgagcaaagtcatgtcttacatggcagcaggcaagggagcttgtgcagagggactcccatttataaaaccgtcagatctggtgggacttaattcactaccaggagaacagtatgggggaaactgccccatgattcagttatctccacctggcccttcccttgacacctggggattattacaattcaaggtgagatttgagtggggacacagtcacaccatatcagcttctcagtacaggagcactagtttatatggctatttacatttcaatttaattaaaattaaataaagttaaaaatttcattactcatttacactaaccacatatcaaatgctcagtagccacatgtggcctagtggctactgcattgagcagtgcagatctagacatttctgtcattatagaacattttaattggatagcactgttatttgattaaaaggtgaatgtttttaatttgtaatgttttaataacaagggaaaatttaaggtgaatgttttttttttatgctctctgattaaaacatttgccatttacttgtgggatgtatctgattatgtgagaatggatacttattttcattttggcctaaatcataggtaattttactgaaaataaaaattttatgtgaaattgcaggaaacctggcaacgcaaatatagatgatttctttttaatgggaagattgtgttgattctttgataaaatacattgagcacgtgttctctatttatgcactccttatgttttactttgcagatatttctgttgattgtcttcatgtgtataacattactgattgccagcctcatctgccttactttaccaggtatgagcttgtgctagccttcagctaatagcatcattaaggttatttatttagctatttgacagagtcttgctctgttccccagtctggagggtagtagtatgatcatagcttactgcagccttgaactactgggctcaagcaatccttccacctcagctaggtctatagctctacttaggaattcaaaaagtatagtaccatattaggaagacaatctgtggaaaaaatatactggaaatttgggtcttactgttctctctagcctattgagaagtaatcatataaagtaagttactaaattatgtaaatggtcttatccaagtgattgttgtgggatgctatagagtttattccgaacaactttttgtatgaggcactcccttagactgctctcaaatccatttttcacattccagcatattcagatagtcttaactttttctaagaaaattaatatggtattctttgattattgtgctttaaaatgttattttgcccactccttattaaaataagcttagttttctgtcttgatgaatgagccaattggaagatagttactctaaattatttgtaatgtttctacatattaaaagtattgacatcacaaataagagaagaaattccccacttttgtcctattatttgcataacagtttcatttggtgataaaaacaatgaaaacattaattccctcaaaagcttttttagacctaaaagaataagtaattggcatgacaaatcagagtgtatgtcccagtagagctcgcctccattgaacttaccttgttttggttgtgatttcatcaaattgtgtactctttagacattgtgatttttgtcttttgtttttttgatgaagacattgatatatcgaatgtgatatctttttcctaatgtgaaaatactaacataacaacatgaagatgacaattctctttacctagccacatgtctcatttatcagcttttctattttcagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatggtatgtgtgtgtaatacaagactgatcttgtatgttaggaatagtgaatatttttccagtcatcttaaatttttttttttggcacatttatttccttactatattgtttcaagagagttgattttttgaattagaagaaatactctttcaagatagtggctttctggttcattcttgttcagagtcctacgttcagatatatgaggtttaaaagaaaaacaggttgggcacaatggcgtatgcctgtaatcccagtactatgggaagctaaggcaggaggattgcttgatcccaggagtttgagaccagcctgggcaacaaagcaagaccccatctgtattttaaaaagtatatgtatataatatatttttactggatcatttagtagcatgtttttctttatacacgtgcatgcacacacctacacatgcttatattacttacttaagggccttactggacactttgtaacattattgctctcagtaacacatatgactcccacaaatgtaggataaaaaaaatactgtaagatgattatctgagtgcagtgatttatgtctgtatgtgtgtaatgttggctgcaactggtaactatgcttaggttactgcttacaccttttcatttgtataatcaactcttaattttttatcgatttatattttgattttgatttcattagaagtttaatatccatttaatattaatgttgaagaaaaatataaaatccatttttatagtgagagattcattatatattatggaggggtataattgctatttaatccataagataatgagacaaccatatttaaaatacagaatccagctaattccagttttcatttgatagtcttccacattattagaaagtgccatatagagaaacaagtattttgtcttccatacacatcatatttagtctcttgttgaaacaggtgtgttttctgaggccacctgaagtaaaagagaggtcatgaggatccaaggccactttaaatcattttttttttggtcagaatttcatcattactcttttataatgtctcctctctgtgtcagctttattttcattttgccatttagtccagttgctagagctgcactatctggtatactagtcaggtggctaaatggctaccatatttgacagatacagggtatttctatcagtatggtaagttctattggaccatgttgttctttgagggagccagtttgatcagctttattaattactttaggattgtgcagagccctccctgtataccagtccacctcaaagttcacagatcagcctgtgtatgggtgggccaccgttggagcaggggccttggccagtcggtagcttttcttgggcaaacagaaacctagtcctaagaactggattgtgagaaaaaaacagcccagccagctgtgtgctttttatgtaagagacttgagtacctgcagattttctggatcctaaaaccagtccccgtggatactgagggatgactgtggttgctctgttaggcatcagtctcaaacctcaaaatggaaatagagtttggctcagaaagatcctctttaatgatgtgggctcctgtttcctaatagatcatgaagactttgatagttgcggtgctgttggctggagttgtccctctccttctggggctcctgtttgagctggtcattgtggctcccctgagggttcccttggatcagactcctcttttttatccatggcaggtaaatgtatgtcttttgctcatgttatttcattaaggatttgagatcagaaaataatcctagccaggcatggggcttacgcctataatctagcactttgggaggctgaggtgggaggactgcttgcacccaggagttcgagaccagcctgggcagcatggcaagacctagtctctataaaaaattggctcatgcgtctggtcccagctgcttgggaggcaaaggtgagaggatcacaggaggttgaggctgaagtgagccatgttcatgacactgcactgtagcctgggcaacagagtaagagcctctgtccaaaaaaaaaaaaaaaaaaaaagacaaaaggaaaaaaatataatttttaattattttaggtgattttaagcagctggtttagaaagactaattttttttttaattctaggaactcttataaaattgtttaatgctctttaatctttcagaatatgcaggtcttataactcctttaaaagtgcttactttataggttaaaatgttactaaccatttagtcttctctaatacttgaaaatacaaattaatagtcattgatttttgttcacctttgaggtagggtgaattgtcttactccttttgacttggaggctttaatacttttgaattattatagcatgttttcccacaaagtcacagattcattaaaaagagtatcctggctgggtgcagcggcttatgcctgcaatcacagcactttgggaggccaaggtgggtggatcacctgagctcaggagttgaagactagcctggacaacatggtgaaatcccatctctacccaaaatacaaaaaattagccaagcgtggtggtgtgggcatgtggtcccagctactcgagaggctgaggtgggaggatctcttgagcctgggaggccgcggttgcagtgagctgagatcatgctactgcactccagcccgggcgacaagagtgagaccctgtctccaaaaaaaaaaaaaaaaccaagagcatcctgagggaacccatgtaagtcacagcaaaggtcttaaagctcatggaaaaagaaatggaacttttctattgtatttagagcctgaggtttttaacatcatagaattaagatctcaagttcttagtaggtattgggggaaaagagctaggtattgacttcagtcattcaaaggctttttagctttgtttttatctgttagtatattgcaatggatttttcagaaaatgaaaattatttggcccgtatttccctttttctgctttccagatggagaacctccacaaacttcatttacccgaaaatttttatttaagtgcttttaatggtgtacccacaccctggattgtatcacccagatgaaaatgaggctagtgcagtaattttcctgaggaatttacacactctgatgggaaagctagacaggtacacaggtgttgtgtggtgtgattaggggaagcacaaggaactgtggcattgtgtaggagagacatttaatctagctttgggagtttcaggtatggtgttccataagagatagtatctaagccaacctaactagtagagaacagagaagtgggtaagaaaggaagaagtatattccaggagggagatgggcagacctggcttgagacaaggcatgcatatgtggggaactgcctcctttctagtctggttcatagactagaataggtgagaaataagtaatacaaagaagtacagaactgacttgtgttttgatttatgactttttaactttttgatggttgaaagcgatacacattcagcagaaactgtactttgagtacttctacagctattctgtttttcactttcagtatagtattcagtaaattgcatgagatagtcactacgtaattataaaattacgtaggcttgttaggcctcagttatactacaaggcaaaaaataaaataggttttgtgttagaagtttttgcccaactataggctaatgtaaatgttccgagcgcattgtgataggctgggctaagctatgatgttcggtaggttagatgtattaaatgcatttttgacttacagtgttttcaattacagatgggtttatctggacctaacatcattgtaagttgaggaggatctaattaagcatatgttatgcctttctgtaagagccgtattccagagtagtcaaatagtatctgtaattgaaggaaagagctaccttttttttttttttttacagaaaaatgccagcaaataaaggtagagagattaacacgattagaaaaatactattttgcaatacctaacaaaataattgattatagcaaggattgttaatggatgttgaacccaacagatgaaaggttgatcagtcttcagttgctattgctgtgtaacaagttatcccgcaactttgcagcttaaaacaaccattttaattttgtccatagagtctgtgggtcagatattaagacagggcatatcactttgcctctgctttgtgctatctgggactcagctgggaagattcaatggctgggaatgatttgacagttatggatggaatcatttggctggaaacacacaactagtggaggggtcaggctgataataccctaacccagtcagtgatcacttaacagtgtgagagttgatgcttgttgttggttgctacccatctggggctgttgactggagctcctatatgtgcctgggctgcttcatagctaagtaacctcaaggtatttgggcttcttacgttgtagttcagggaaatgagtgaccccacaaacaagaagctgcatcatctttaatgaccccatgtcagaaggcctacaacatcacttttcagtacattttactgggtataagcaagtaacaaatgttggctaagattcaagggaagaggacatagaccccctaccacatgatgggaaaataatttgcaggtatgttacattgcagtgtgaaagtggttatttgaatggtggcaaagtgtcaccttatggattactttatggctcaaagggaaacacacaactagtggaggggtcaggctgacaataccctaacccagtcagtgatcaagcaaagtactgctgcaaatgggacaaacagatactatctgccttttaatgttacgcagcatgagccctggaaaaggccagagcatcccgtggcatcaaggagccatcttggcactgttagccaggccttagtgttctcctgttggacataaacaatttgacagaacatcaacatcatacactgtcactctgtgatcaagatagaggaagacaaaagcaagaccctctgcaatcatgtctgaacacagacagaacaggagcattattcaaaccacagaaatgaccaaacattcccctttactggctaacatgattggttactgcctcattaccaattacagttttagcttctgccactttttctagataagatttatttattaagataaccattcacagattactctgctttctaatagcatctgatacagaccaaattcctgcttcttaaatcctcccccaaatccctaacataagctgaaatcctgtaataacccctttctagcactcttactgaggggccccaagttctccatgatgtgttactcccttgctgcaatgagtaataaatgcaacttgttctagttatacttgtatttttggtggtctttacagtactcagcattacttctgaaatcatcatcaccttagagaattctttggtactatcaaagtttaaaaatgcttatatattatgactcagcagtttggcttttcagaatctactgtgaggcatgagcaaggctgtttctgcaaatacatcattttttatagcaaaaaatgagaagtgatctagatgtccaccaatagagaatgcccaaataaaatgtggaatatcaatgcagcaattgaaaaaatgaagtagagatatttgttttgatatcgatagctcccagacgtgtttctgagttgggggaaagcacaagctgtagacagataatgtgcagcgtgctatccttaatgttttgcattaaacccccaagtttttgaaggaacagtttgctttttcttaattcatgactttaagctacttgcctttcctgcagcaagtggctgcagctccgtgggatagtgggccagttggaattctagcagagcagctagtgtggtgtgtcctgtctggcaggagaggactgcaaagcagtgggtttttggagaacgcgaatcacagtgatcttggacctccttgggtaaacattaatctcatttgggtgtctgctggactcccagaaggccaagagaaagctgaattggtgggttgttgcatcttccctgcctgtgagaaaaagcagggaggctttcttcatgttcctcagtaggagactgttggagggctatcccaaaggtctgaagacgtaaaagatccttttgaagccctttaggatattctcagccaggcccaagcctccttgaggctgcagaggaaattataacaagtgctttatatgcaggaggcttagcagccgcagaaaggaagttaaggcagagcagtcagaacacatgccagtttgacagcactgcttgcagagccatgagcttccagagagaagaggaaatacacggacgccgagtgcagtatgttcacacgcacatacaaacagcagctctaaagcagaacgcagttgttgtggagctgtatgacatagatttcagacaaatctagtagtgaaaaaagatgtggacagtcaccactgggcttggcttggaggcttggaagatgaatgcaaagcactgggcaaaacggaagaggaaattgagaaagagaaatgttttggaggaaacatctaggagacttagcgtactgataacgggggttccagaaggaacaaatgtgaggcagcattgatacaaaaacaggagaaaatttaactgaattgaagaaagatctgattctgtagtttgaaggggctcatgagatttggtaagattgagatccaagataaaaacacgtaattgggtatatcttattagacacggggaaatcaaaacaagcttcaaaaaactgcattgtcattggactttttttctgtagcactgaaaaccataagatcagagaatttatagacgactgggtaaaagggacaaaagccaagcttcctctacccagacaaaaaatcatttagctgttcacctatcagggtgaagattgatatttgagggtattcaagaattcagtgtatgtatcaacctctcaccccatttgaagaagatccttagaataaccaatcaaaccagtaaagaaatgggaacattggcctcaagatggtagacagtgaagaggagaattaacaatctgagcaaagtccatatgaaaatgatactacatactttctatgggatatagatgtatagatgcagctgaatgcatggggaaaaacatggatggtatgtaccaaaagctaatagtggttattgctggggagggatcaggatttaaggtagtgatcacagaggactcccgtcttttctgtaaagattttggttttatgtaagaatcagtctaaatgttacatgtggtttctttttttttttttaataccgttttttgttgttgttgttttaaataagctagatagagaccaggttataaagggttttgtgtgccttgctaaggacttcagggttgttaagcagggaagttacgttcatgatctgatttgcatttaaagagatacttggtggtggtggggaagggggctgtggggagggaggaagtagtcatcactctgtctggtggagagctggagggtgggcaggccaagagtccgttgcaccatgaggaggaacctagtaacagttccccagtagaaccacaaatgcttcaagctagaagctatctgtgagcctttagaatggtttcttaggccaaactttgctccacagtcttaatttgacataaatcagctcacttgaaaccaatgaaatagcctaaagatagtttgaaataaaatcttggcatttattttatttgctttttgagatatccattaatgaccagactttctctaactcttgggaaaacaatatagatttttaaaagatagaagaacaatttttgatggaaacattgaatttgagctgttgaagaaaaaaaattctctgggttttcagtacgttagtcttttgtaaaattgttgccaatcctatagaacttctattttgatgtgaaataatgtaagaaaattatacagcctctctgctgtgtttattgttaaaaaacaacagaaatatgttaaatggtttttaattccctaggactgggcacttggagtcctgcatgccaaaatcattgcagctataacattgatgggtcctcagtggtggttgaaaactgtaattgaacaggtaagcaaaatcagttttcagagaaagacattctggaattggttgtgtttatgtttggcagctataactcttatttcttatcttcctaccttgctgagttttctacattttttttgatgggcatatataacctttttttttttttttaaagacagcagtttagttttaccactgtaggggaggaaaataatttgttctcaacccttgttttttttagttaaaatggaaccctttaataaaagacaacagaaaaacaaaagtttattaaagtacatatttcatatatacatggagatacccagggaatgagtaatttcaaagaggtggctttgaattccaacgaatcttcaacaaagaataataaatttttagagaagtgacaagatgaaggaaaaggactttgagtctctaggggtggcaagtgaggggaagcaaaaaattggcagatgcggctccttagtaaagcttggcagtgttgattcctctggtgccatctagaggcccagaaaggcccaaagctctcttcagtgggtaatctttgtccttcatggtgtagggaagtggggtgggctaccttttgtctttatacatttatattctgcttctaggcaatagagggaggacggaaagttttcctgcatctattctttctcagttgcattcaactcaaaacaatccttatgcctaagaggcatatttttagggtggcatattgtggttttctatactcccatgaattttcatcaaccacgtttaagccatcctttatctgaaggttaaccagtagcttacggtatctagaaccctgttcatagtggagacaaaaatgaaaatacgtgctttttttctggtgaaggttgatattaatgtttctaagcctgtagtagatttggagtgggggaaaggttattgctcgaggtaataaaagaagacagaggaaaaaacattacaaaaggagagctgttttggcttcatctagctacatagtacctaagactattattgtattacagaactgccagataatttgattgttgtgggaataccttggaaaaggtagactgtgctttagcactccgataataagactagaaagtatggtaattcatttaaggaaaatttctatccaaaatggccaacataacagattttgctgctactttacgctttagctatatggcaaatgtacttgtggggacccctcttatccttaggccagtgccacataagtaagacataacagttctgcagcagtaaagtacacctctttttgctgtatgagaagtaaagacagtagttagccaagcatgctcaagaaaatctgttcaaaaagtgcctgtatttcaagattttgattcttaggagtaggggggttagggagccagcaaattgcagtgtgtttgtgtgtgtctctaaagtatgggctaattctgaagtccaccaggagtgtgatggattgggggcttctggcttcatatcccttcaggatcagagtgcaggccagtacactctagaatggccaggttagcctctggcccttgaaaaaggagcatggagatgggatttattcatactggaggctgtggaacatcattgatcttctaaataatttgttatcttattcattgttttctcttgcgtatgtgcgtgtgtgtctctgtaaatttaagaaaaatggttggaaatggttgagaaacactgggatgccttgcttcattgattaaaatgcatttgggttaactaggtgtctttgggaatggcagcatgcctttaaaaggttaagcatgtttgccattcaaattccgaggtgatggggttgagttatgctacattcagtcacagctaagagaggtttaagtgctgctggtgaggcaagaggagaagaaaataacagccttctaagccttgtttctgtctgcactccatctaaattttctgttcccagggttttcccatttccatccattctttcctctgcattactcttgtagaattttctggataagatgatggaaatattctagtaattcttggacttgctttttttatattcactatagaattctttcatactaaatttttaaataccttttgatttgttaaaatttgatttatgcaagcttttcagaaacgcttcctgcttcagtgttttctcatcatactcagataaaatgaatgcaatattgtataataacacaatattacatattacgtatctctttcataagatgtatgaagttacttcaagtaatgtggtcttgaatgaataccactgaatgtcatctggtattgtatagtgcaagtagagtataaattattctagattagtgtcttatttcatcacttagcagagctaactgcagagcgttagtgggtaaatacatttcttcagaaactcgtgggcactatgcttatgttgatataccagaatttgccttgactttagaagaagtaaccagtttgactatttttgggttggcagattcagttgtgtggagattgctgtattaacttggaggaatttgtcttgtatctttgttctaattgctttttgtaatgtttcaggtttacgcaaatggcatccggaacattgaccttcactatattgttcgtaaactggcagctcccgtgatctctgtgctgttgctttccctgtgtgtaccttatgtcatagcttctggtgttgttcctttactaggtacgtaatgctggttgtggagccttgaaggagcacttttattaacattggacattctctttacccctagtaaaaaggatgtctcactccatatgctttatttgtaaatgtgaatccagctaagacaatgatttcaaaataccacttttcttagatttgactattctgggtaagattagaggatcataaagctctttgatacagttcttttctctaccagaagataaaacttgaaatttacatgctgtacaaaataggcaggatcagatttccttcaggttgtcttcttctgactagaagtgctgtgatcatataaaattaagtaacagtgttgttgtatttaagttttaaagaaatattctttggcataaaagatccaaagaggagatgctaatgggcaacacgtttatactgaaatacactgtcttgttgattgtgtagtgaagactcctcatagctccttaaacccaacatattttcaaaattataagcagagacttttccttcccaaatctttttcttctccagaattccgtctctcagcagcaaacattatcatccaacaaattgcataagtcagaaaccttgaaggctatccatgtcaccttattctgtcctccatgtccctctggtctccaagtgtcccattcttccctgaagaatctggtctctcgtctctggagcctttgctcctgacttttgttgagtcattcgtctcctaccctaactttggcaccttcctatctggtttcccagccttgaacctgccatcactaattccttctccacactgggcacaatgacctttcaaaagaatgaatctcattgtacctctttggtgaacatttttttcattggttcctctgtggcctttaatgcagtccaaccttttggcatagtttacaaggctcctccttttgctttgatgtgggcttcagtttgacctcactccatgtcatatactctgagttttgattaaacaaccatggaatggcctcttatcaaacacacaatgtcctctccataactgtctccacattttcatttgtcttatccatctgccagaaatgaccccgtcctccctttaaccgtgagagaggagcttaaaaaaaacacacaaccaaacttgcagtgtaacatgtatacttgtatgttaccttactaggtcaagaaatagaacttttccagccctttggaagccctttgtgtgtgtgcccttctttaccttttgccactggtttgacttctaatagtctcattgcttcttagacagtaaagatattagccatgtgcagtagctacttgggaggctgaggtgggaggttgcttgaagccaggaattgaagaccagtctgagcaacatggcgagacccaacctctaaaaaaaataaaaataaattatctgggagtggtggcgcacacctgtaatctcagctgccctgcaggctgatgcaggaggattgcttgaacccaggagttcagggctaacctcaggttgtgacactccaatctagcccaggcaacaggccaagaccctgtctcaaaaaaaaaaaattgctcaacacaggtttgtatagagagaggctgagcaatgtatccctcagtctgcaggatggcatgggaaacagggaacagttaagctgagggcccacagtgtgcaaactgcatcatttcctggttccttctaagtagaaacttcaaggcttttatttggtttgaattgtgactatgccaagtatcataaataccatattaaaatgcaaatatatatttcctgcaaaatatatttcaaagcccattgctttttagttttttttttttttttttttttttttgagagacggagtctcgctcttttgcccaggctggagtacagtggtgcagtctcggctcgctgcaacctccacctcctgggttcaagcgattttcctgcctcagcctcttgagtagctgggactactggcatgcgccaccatgcccagctaatttttgtctttttgttagagacagggtttcaccatgttggccaggctggtcttgaacttctgacctcagataatccacccccctcggccgcccagagtgctgggattacaggcatgagctaccacacccagcgcattgcttattagttgaatacgtctttaaaattaaattattttgactctttagaacaatctctttactggttttgtctagagtaggaatgccctattttcttttttattctaattagcatatattatgttctgcccattaatagtatatagacttaagaatttggatttccaacccagtcattcatgttttcatttttaaaaattttattgtgagcatttctggaaagactttggaagggaaaaagagtggcaaatgaaaaatgttggtacctgttttgccctgtttagatgctttatgtaattcttacatgttattcttagggtagctttttaatatgttttgtcaactctgttttagaaatgggaaattgaggttcatagagattgagaatcttaccccaaagtctggtttttaaggagtaagagcagcattcagatttcaaactcagctccagagcttatgcacagcacactattgtggtgtttggaataatccacctgacggtattaattttctgaattcctcgaaagtacttgctctgattttaaagccccccagtcccctctgccaaagaagtattaaaactcatgagttaaatatagaaaaataaatacatgtgtgttctaaaagtttgaggatttttttattatataagcacagttttggttttgcttctttaaactgtggtgcagtagaaatgtatcaatgacaccactgcttgtggaacatgagaagtcatctcgtccagttcctttttttttttttttttgaggcagggtctcactctgttgtccaggttggagtgcagtggcttgattgatctcggctccctgcaacctccacctctcaggttcaagcgattctcccaccccagcctcctgagtagctgggactacaggtgcaacgccaccacacctggctaatttttgtattttttggtagagacagggttttaccatgttggccaggctgctctagaactcctgacctcaagtgatccgcccgccttggcctcccaaagtgctgggattacaggcgcgagctactatgcctggcctccttgttttacaaatgagaaagttgggggtcagaaagggctcatgacctacacagattgtagaaagttaacagacctggggcttagaaagcttgtctgccccagtccattcttctaggggaaggacatgtttacgtttcatgtcactgttatttcacatacactgaaagtttttcttttttggttttctaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaagtctggcgttctgttcgtctcttgtttaagtgttttcacttcttaatttatgtatctgatgtgacaaatcataggagggaaacatgctcagattctggatatacttggaggtgggattagcaaggtttgctgacagattgtgacatgtgaaggagagtggaatcaaggacttagttggcccaaacacagggaatatggagttgtcatttatggagctggaaaagactgggtgaaactgttttggagagggaggttttttttttttggtggtggtttttttttttttttttttgagacggagtctcgctctgttgccaggctggagtgcagtggtgcgaacttggctcactgcaacctccacctcccaggttcaagcgattctcctgcctcagcctcccaagtagctgggattacaggtgtgcaccaccatgctcagctaatttttgtatttttagtagagacagggtttcaccatgttggctaggattgtgtcgatctcctaacctcgtgatccacctgccttggcctcccaaagtgttgggattacaggtgtgagccactgcacccagccaagagattttttaatgtccattccaaatagtttttcagtctgttttcaaatgttctggtctgacagtatattaaacagttttagataaaaataagaagcctgcattagaaactagcagtgcctgcataagcccctcttgcttatagagggccactaggttactctgaggttgcacagagaggcttgagggttactgcaaaaatgttgtgggactctctgttttgaggaaaccattgaaaactctgtcacttgatctcagtgagagattgaggaaagccaaggaaaacaccttcctgggataatatttgacctttatgtccgaactgtaggctgaatcatctgcttcaatgggttctagcagagaaagtgagtttatggtttatccatctcagtcggccaagagagtcccagtttatacctgctgcctttgtgtcattaacactacccccttttacttgtgcttgtccccccttgcacaacaaattatagagttaccttatttattctgaggagtaagatttttgagaatgaaatttatagtgttcaagacttctccaaagcatttactgacagtaaaaaatacaagtacacttaggcagtcagagtacaaaggactgtcaactgaaagaaggggaaggggtattttcaatgatgaaaatcaacttcttagcactcaactttttggcagaggagtaaatactgcaaacagaatgacaagcaagacgtgccctcagggaactttctacctgcttctttctttatgctggatgcctgcctttctgcaccctgcccttctcagcctttgccaggggtctagacgttcccattgacctcttctttctcatgctctatcttcttctgctttttcctgtagcccagtgtcctctttcctcttttcccatctgttcctttatgcagaaaggtgttgaactgtagacttaagtgagggcatgtcttgtcagctgttgtatatgtactctttagcacagggtttggtctgtgggaggtgctaagagtgagtgagtgtgtgtgtgtgtgtgtgtgtgtgagagtgtatgtgtgtgtgtggtgggcttgagtatgagagagtgagtggtggtggaagagagggagttgggttcagagtctcctttctctgccactgaattactctttggacttgtacaatttaacttggtttctgtatgctttttatttacttactttgtcattgccataatgctgaccatatttttagtgtatcttgctatttagtcattactgtgtgccaggtagtgctgtgtatattttagtagatattgctcagccttcactgtttaaaatatttacaaaattctcaaagttttaaaatcagtggttggttggggaacagtggggtaaggaatggctaacttcaagaaaagaaggtaagacaaaagaaaaggaataaaacagtgacattatggataaagatgcagtaagattagcgtacttttaaaaaagtgacatattaagctactggacataaactgccaaaatatttccttaggcttgtgtgcatttacagaaaagtgatagataaaagtcaaggtagagaaggtactggtgaaaagtaagagttcccacagtgagcccttacaacatgctaagcctttgtcaccgggctgcatacactttccctttcttaaaacaatgctgcagcgtgggactgtcggtctcatttcactgatgagtaaatggaggaaagggacgaaggaaagctacctgacagcctgtcatgtgcaggtttcactctccctcagtctccttcactcaactctgtgggcttttactggacattctccctgatctgcatctctgcctccaaatgggtgcccttcacacttgtgcccagccacctacagcttgttgctttccagctttgtccctgctgtcctcttgggatcagcctgcaagccatctgctcacattaagtaaggcaggccttcagtgagccttcgatgcagctgtcgcccttccctggcattggagatgtctgtctccttgagtaggatctcctgccctgtcactccaactacagtaacatctgccttgtttctgcagccctgtggcctttgccattgccttctcctttcatcacatacataagttaggaacacttgccattctgttgttgaaccatattctcccacctcctgtcactcatactcactcactgcaatgctgtcttccctttgacttcactgaaatttctcctttgatttctcctttcttctctgtaactagaacttccagttttactttcatcccttcctactttttttttttttttttttttgagacggagtcacactctgtcacccagactggagtgcagtggcacaatttcagttcactgcaacctctacctcccaggtttcagcagttcttctgcctcagcctctctagtagctgggaccacacacacccagctaattttgtatttttagtagagatggggtttcaccatgttggccaggctggtctgaaactcctgacctcaggtgatccactcgcctcggcctccctacgtgctgggattacaggcgtgagccaccacgcccagccccttcctagctttctgatggtcatgtttttagtctgtctccttagatctgcccactaagttgttttataaaatctgaaccttaacagataaatccactgcataagtttactgtatccctcctggcctccacaggtctgagtttctgagaccccctaaaccactgactgaagcatgtcctccattgcacagcattggaggccttccagcctgtgctgcttctgcagcttcctacaaacccatacctaggtagatgtgtcagcctttacaggtgttcactcgggactccctttgacttgcccaaccattgacgagttttaagtaggagttagatttaaaaagacatatgaatgttttactctgtacattcatagaagagagtaaccaccttgtttttgcaacctaggtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattggaaaaaaaaaaaaaaatcagtatcagaaataatgcttgacataggattcagtgttatactctttggcactttagagcagccttttctctcatttgaaataaggtctttgttagccctacctttactcagaaatttagtcctactataaaaaattaggattttaaaatataatgctgcctgtcatagtgtatttctaaattgctctctttgggagaaaaacattattattgaattgagcatataactatataactatataactatatatatatatatatatatatatatatatatatatatatatatatatatatatatatttttttttttttttttttttttttttttttgcccccgagacagagtcttactctgttgcccaggctggagtgcagtggcacgatcctggttcactgcaccctctgcctcccaggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgcctggccaacttgattatattaattttgggttttttgttttgttttgttttgttttttaatttttcaaagaatttgtggatcttggtataaagtcattggaacatatctgttttaacagcaagagatcctaggcagatacttcaaaaggttaaaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgtagtctagtttttttgtttgtttttgtgttattgcaagattgctttaagattgcagaaatatgcattattagccagcatagataatccagatgttataataggaaggaaaaacaactccagttaaatgtgactgtggcgactcccttttatgtatacatttaaatgcatagttgcagaggacacatccctccccttctgtctccctaacttgaactgtagaccgtcctcactgggaagagtaaggccccacattttgtgcaatagcaagctactgcccacttctgcatgtctgctacgagatcagaaagtcagtttcactaaggttgtcttttagctgaatacttagagtaaaaccaatcaaatccattgtacatacctgaccatatgtcccagataaaaaggaaagacttgcgtgatgtttttttccttctgagtgccctgaggagatccttttgcttcagactatttctaatttttctttgtttataggttcagaattttttccatgattgttttcccccaaacaagtgcatttttaattactttaaatgcaggggtgatagaggaaatgctattcgaaccatagacatctttaatctgtgaagctgaaatttttcagcaaaggaaattgcatggtcaagttcagaaactggccattaatttcccccttccgctccacagttcatagctactcttgttgcaaacatgtagtgataaggagaactaacgtatcaaggggctgagagggtaacgttcccctcctcctccatgtttttattttggtgtctgttttgtttctagcactgtatttagtactgtagttgaatgaggtatgatgtctcccttcaaggaactcagaatggaacagaagcatgagcaaaagattgtattacagaggtatgaataaaatgccatggggaacacagagaaaggttcacccgggagagatggcctagccacttccttagtgactgtttggtatatgtaggtccccctgccattactctttcagccttctgcaatctagttctacttagtcacacacttctctaagaccactcatacgtaaacactacgtagaggcccctttttgcctcattttacattgtttagttatcattttgaaacttttcttcacatatgtaacagtgccggagtttttctgcttctctgtgtttgttcagtaactcttctttaggatacacctaaagatgagaagcttcatacccagtactcctcttcattcactcatatgtttttgggatcagtcccttctgctggctgtgcattggtctaatggaacagaatagagtccagaaataacccaacatgtatgtggacaactggtttttgacagaggtgcaaaggtcttgaaaaaatgatgctggaataattgggcatcagatgcaaaattaaaaacaaattgatccatatcttaacactggcaaagattaaagtccaaatggattatagttccccaaaactgtataatttctagaagacaacaaggaaaacgtgttcagccttgggttaggaaaagatttcttaaatccaacaccaaaagcacaatccatgaaggaaaaatcgataaattgtactttatcaaaattgagaacttctctttgaaaggtaccataaggagaacaaaaagacaagctgtagagtggcagaaaaatatttgcaaaacatttctgataaatgagttgcatctagattacataaagaagtctcaaaactgaacaagtaaacccattgtttacttaatcgctgtttctcctgagcttgctgcctctgcccctgctctctctccttttccatttgttttcaacattgaatccagaatgttcttcttgagatccaagtcagatcacaccaaccctcagaactctccaatagacgaccatggcactcaaaagtccacaatagccttcaatgctgggcaaaacatgaagcaccccttttctcccttctctgaccccatcacctctgtgttcaccctgctcctgccgtcctccctgcctccaaaacaggtcaggccttcgtgcctttgcacttactatttgcaatacccaaatgttcttcaggctctttagcctcttcatttctttcctgaagtgtcattctcactgaggcttatctaaagctgcagctactggggcattcctgtctcatctccctgctgtattttgtactcccggctctcttttgtacttttaaacatactatatggtttacctttgttgtttatatttgcatgttgtttcccacttgaatgtaagctccaaagattttatttttttaaactgaattattactgtattcccagaacaattccctggcaaatatttggtactcaatagtaatgctaagttagtaaataaatgatgaatttagaatcaaaataatgtgtctatggccaaaataaaacctgaaatccctgtcctatttcccagaggtaactgctgttaatagtttagttgtgtgcttccagacataccttcacagaatcatttatcacaataaaggtgtcatactatgcagattgtttgacaagatgctttttttcactttacacgggcatcttttcataccattgtgtggccaggccatgatttgttttccaaaagacatttacccaatttatatggtgaagatttttgtccatattactttttatagtatttctgtagggtaagttcccagaagtaatattgcacgatcatcgaaaaattttagtgttacattactgccccataaaggtactaattaacatccctctcaacaacatagaagattcctttttttttttttctttttttgggtggaggggggcggggacagagtcttactctgtcgcccaggctggagtgcagtggtgccatttctgctcacggcaacctccacctcccgggctcaagctattctcctgcctcagcctcccaagtagctgggaatacaggcacgcgccactacgcccagccaatttttgtagagaagggggtttcaccatgttagccaggctagtctcgaactcctgaccttgtgatcagtgctggggttacaggcgtgacccaccgcgcccggacggatttcttgttttcatactgtcatcaactttaaatacaagtattttcagtttttgccaatgctgttaatttagaaatgtgtatgtatatattgtctggtgggtgtttggatggaaacgatcaaaatcgggcaacttccccagtttccttgaagggagtgcttgccatcggcccctctgggaagtagctctccgtagttctccatcttcctgttttgaggaacgcaggaggaggtggatctggagtctcatccattcggtggctgttaacggcaactgcagcagccagccaggtcaccccctaaagcaaagttaaccccttgcatggtgccttggtcagcacccaccaaattcgaggtttctcctatccttcgactcgaggctcttttgacagatgtgatttatttcctcctagagccagtcacattggctcaagcaacctatcgtaagaaaacaaatacaatagtgttttagctggaaactgcccactgtctaagcggctttttaaattaagaactcaggttcactacgggatggcttaggccagggaacagcatgtgcgaagttcgaagcccgagaagtttggaggagcggccccaggcgcaggcgggtcccgcagcggggcccgtgccgcccaggcgatcagccccttcacttaacccgcttccctcctagcaggcccgagtcccctagcctcagcctcacgcagccagagcaaggggaagagggagtccttcgtgagttcgccgctcacattcggcggtgggaaaccgatccgaagatgcttttgtaggcgaaacgctcagctcgcgcggctctgaaccaccggggagcagcggctgctgctagtcggactacgccagcacctccttgtccagcccgggagcagccccgcctcgctcagggccgcgtgcgcgtgcgcggctccaggggcggggcctgctcgcgtcccgggtgcctggataccgagcgcgtccgtagtggcggctggcgctagggaactgcagggtctagggtgttgtcggagtggcagttggtccgaatttctcccgaagcccgcggaggagcgggtaagagccccgcgaatccggccccaacctcgggaacgggatgggaggcggccctggccgcaagccccgcgctgctagcgggtccaccgcgtcgtagccgacagccgcccttcttcctcgcagcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcggggtaagcgcccttggcccggggagctgtccggtctacatgcccaagccagacgagcccagagagccctcctcccggaccaggggccttacgcggcactcagcgtccttaagagtatcaggcaaaactttccccttagcattggtgacatctatacttgagtgttttatctaggaaccatttcgatttatcgactatgagacccgaaatcattgcaaaatgctcacttacctacaacgtaatggcaactcaattgtttaaaagtgtttatgatgaagatagactaaaacttaacaaagtaattgcattgggcaaaaaagtgtttacattatgttaaaaaaattacacggttgcagtcactttgtgaaatgactttacaaagaggaatattttagctaagttcctcatctgcagagagtcctctcagagctatgtatacccagagctggttaaatttattagaaccggaacgaccgtggtcatactgaggtcatcatccctagagtgctcagggtaaactgtccagcaaatgaagcttcacagtttattttttgccacaaacattccaacacttgccaggaacagacattcataatctcaaagttacaagtcaacagatcttagaggcattaaaagaaatcctcttggttttacaggagagctctttgccccttttcaataaacagatgtaaaacaaaaactcacttttatgatgacaagagtcagcacaggtgtaaatttaatttaaatattttagtcatcaacatttcaaattttggctgggcttggtggttcatgcctgtaatcccagcactttgggaggccaagctgggaggatcacttgagcccaagagtttgagaccagcctgggtaacacagcaagaccccatctgtattttttttaataagaaaactaatttaaaaagaaaaaaaacagccaaattttgctggctttaaactctataaccaaagtgaattagtttcgtttggctgctgtaacaaatcaccacaaaacttgacagcttaaaacacagacatacatttgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcccgggcgacagagcgagactccgtctcaaaaaaaaaaaaaacacagacatacattcttgcagttctggaggccagaagtccaaattagtttcactaggctaaaatcaaggtgttgacagggctttgctctttccagtggttctcaggaaaacccagctcgtttccttgccttttctggcttctagagctgcatttcttggacgccttggctcatgtccccttcctccattttcaaggccagcatcttcaaatctccctctgcctccttcttccaaggacactggtgattgcattcagtggccatccagatagtccagggcagttttcccacccgagatccttatcagtccacaaaatccctgttaccatgtaaagtaacattcccaggttcctggaacatggacctggatacctttggggctgttattttacccaccaactgagctacttgtccatccagtgcttgccttctgagaaatgcttttatcaatggtttctgaaagactctttcaaagttcttgctaaagaaatatagcctctggttttaaccattattcaagcttaaataaaaggatttataagagtttgtgctgtacaaaaaattccaagatttagcaacatcttcttggaacattaaactatatttagtaataccttagagatagttatgttaagcttcactttgtttatttatttatttatttttgagacggagtttcactcttgttgcccaggctggagtgcaatggcgagatctcggctcacggcaacctctgcctcccgggttcaagcgattctcctgcctcagcctcccaagtaactgggattacaggcacttgccaccacacccggctaatttttgtatttttagtagagatggggtttcaccatgttggccaggctagtctcgaactcctgacctcaggtgatctatccacttgggcctcccaaagtgctgggattaccagtgtaagccaccgcacctggcctaaacttcactttaagaggcttaatcaggctgggcatggtggctcacacctgtaatcccagagtttgggaggccaaggctgatgaatcacctgaggtcaggagttcgagaccaacctgaccaacatggtgaaaccccatctctactaaaaatacaaaaattagcttggtgtggtggcacgcatctgtagtcccagttacatgggaggctgaggcaggagaattgtttgaaaccgggaagcagaggttgcagtgagccaagatcgtgccactgcactccagcctggatgatagagcaagactccatcataaaaataaataaataaataagagacttaatcaggaactttccgaatgtaccatgctactaatttctctcaagagccatttatttatttattttttagatagagtctttttctgtggcccaggctggagtgcactggtgctatctaggctcacggcaacctctgcctcctggttcaagcaattctgccttagcttcccaagtagctgggattacaggtgcgtgccaccacgcccagctaatttttgtatttttagtagagacgggggtttcaccatgttggccacgctggtctggaactcctgacctcaagtaatctgccctcctggcctcccaaagtggtgggattataggcttgagccaccgcgcctgaccaagaacaatttgtgagtttaggagaaaacccaggtattattcattcggcagtatatatgtaattgtaggttcaaatatgtttcagctgtcacaggacagaatctgttagggagagctattcaaaagtaacttgagtaaggcgggacttggtaagtgcaaaaatgaagggtcacgaaagttaagcaaagtagtggcttggtccttgagagattttgtaggcagagagattggggcttgggtggggtggagaggattccaggaagaggaagcagcacaggaagaagggggtggagacaggaaaaagaaaaaccatcaaaaccaaaacaggaaaccaggatacccacggacataactgctatagaacaagcaagtaggctgagcacggtggctcacacctgtaatccctacattttgggaggacgaggcggacaggttacttgagctcaggagctcgagaccagcctgcacaacgtggcaagaccttgtctgtactaaaaataaaattagccggccatggtgatgcatgtctgtaatcccagctattcaggatgctgaggcagaaggatcacttgagcccaggagttggaggcttcagtgagccatgttcacaacactctactccagcctgggtgacagagcaagagcctgtctaaaaaagaaaaaacaaacaaacaaaaaagatgaagcaagtaggcattcctctttcctcaggttagggttcttttcaaaggtgcttttcaggtgggcaaatatcaaagatgagccagcctccccctaagcctgtggactccactgtgaggggagtcggctgttccttatgacaccattgtgcagttgtgcctcacacaggacaatgaacataagaatcagtcaagtaatagaggctgctttggttggcgtgtgcctcaaggaactggcagaggctaacattagttggtctcacctcaaaagcaggcatttccagcctcggccctactgacagttggggagggcacaggaggaaggggcatcttgtgcatgatgggacttagcagcctcctggcctgcacccactggatgcctggagtaccatccaccctctgttgtgacaatcaaaaatgtctccaggccgggtgcggtggctcacgcctgtaatcctagcattttgggaggctgaggcgggttgattgtctgagctcaggagtttgagaccaccctgggggcaacatggtgaaaccccgtctctaataaaatataaaaaatcagctgggcttggtgatgcacatgtgtaatcccagctactcaggaggctgaggccggagaatagcttgaacctgggaggtggaggttgcaatgagctgagatggcgctactgcactccagcctaggccacagaacgagactctatctcaaaaaaaaaaaagcgtctccagaaattgccaaatgccttttggctggggaggagggtggcgggtgggggaaagaggaggagcattatcccccactgagaactctgcctccagaggctgtatctagctcgggattccttgcctgagttatgaggagttacccccatgaaataggtgaaaaccttgattagtaggaatgtggcaaaacgaggcacctattcttcacccacaccctttaggtctttaggttcacatttgtctaactcactgctgccttcaaatcattaacaaagccacaaaatggagctgaagttgtcttacaaagcaaggaaacaaagtcaaatttgaggggtgtaaagagagagaaaggatgagatatgaagtttattttagtctatcagatatcgacttatccatatttatctgtagcaatgtttctaactacccatggctttaaaattgttatctgtggccctggtggatgctttgatgttcatttgcctggatatgctgtctcttttcatcatgctaaagtcattagggccccaaatgatgtggcttcagcatcgccacctctggcaaagataccaaggggcgtgagtttctcagaaggtcttgcctggcacccctcccaccacgagccagaggctgggtgtgggttccctcttgacttattgccccaacagtttcccactcttgcccccaacataagcagcaatatcagtgtcccagaaaggaacaattaaggggaacaataccaggcaggaaaagtgggggtggggggatgggagccaggccagcacctgccattcccagtgtggaagtaggtgacctgtgtgttcctgggctgcctcagggttgaatatgcagagacgcttaaagtcaagcacctcaaaaagcagcaagaccaaacccacctgtcaaaagtgggaagacggccaggcacagtggctcacgcctataatcccagcactttgggaggccaagctgggaggatcacttgaggccaggagttccagaccagcatgggcaatggaacaagaccacatctctgtaagaaataattaaaaagattagccaggtgtggtggtgtgtgcctgtagtcccagctactcaggaggctgaggcgggaggatcccttgagcttgggaggttgaggctacagtgagccatgattatgccactgcactccagcctgggtgacagagtgagaccctgtctcaaaaaatttaggaaaaaaaaagaaagaataatacatggaactccagctgattgtgaagtggcagggaggaggggaagaatcacacatgttgaaggagcttctgcgagtgccagccactgcgccaagcccttctcacacaatgctccccaaccctccaacagggagtctcattatcccctttgccaacagagaaactaaggcaggcagagaaggttaagtcagagaaccaagtggaggaaccaggacataagcccgggatgttggtcttcagagctgtccttcctaatcaccgttgttttggggggttatttaagaaattggatcgcatagctgttttttgtgtattgatgagctttcagagatgtctgttatttattagctatttttcagctctgtcgagaggagatccacttcctgtaaaggacagaatggaaatgcccacggcaacccagaaaacagacacaggcctgactcaaggactcctgaaagttttgcacaagcaggtatgggggggcgtagtctctggcctcaggcagctggcctgtgctttccttaccgttcactgtgcattgatgacagagcggggcacaccccagcaatgtatttcaaacctcctgaggtccctgaaatcctgctttccctgccacgcatcgtcaaggttgattcaaggaagaaatatgttgtgtctgggaggtctttttctagcttcaacagccccaagtcactatccaggggtagagtttagaaaagtgaaatataatttcttttaaatacaaaatttacatgacactagattctgctgggcaaaacatacaaaatttcagaacctggggggtttccagtccgttctccaggtgtgtgtttgtgaaagctgtgcgcaggcctgagtaagcctctgccttctctgtctggaaggcggggctggcctttggcccccaaggtgggcagcagcctctggtgtccagtgctgtggagagcctgggcccccttcctgccttgcgcttctttgccccacacgccatcctgtttttacagacgtgagttactagaaagtgggtcacggagcaaggctaggccttcctcatgactcggttcttttgctaaaagagacaccagtggcataaccttgattttcaaactgacttatccccattctacactgtgaagtactgtgcttctgcgcaggatacagtgaattctgaaactaggactaccttaagggaagcaaagaactcttgaatggtgtagcttgcgaaaagacatgctgaaattgctcaaagccttttcatccaggatactgctagcagattgcagaagttttcagttttgatagattgtttaaaatagtagaaggaaggccgggcatggtggctcatgcctttaatcccagtactttgggaggctgaggcgggcagatcacttgaggtcaggagttcaagaccagcctggccaacaaggtgaaactttgtctccaataaaaatacaaaacttaacagggcgtggtggtgcgcacctgtaatcccagctacttgggaggctgaggcggaagaattacttaaccctgggaggtggaggttgcagtgagccgaaatcatgccgctgcactccagcctgggcaacagaatgagactgtccaaaaattaacaaataaatatataatagaagaaatacatttattttcagttttaagatctctcctatctaactgttaatgtgattaggggctggatttttaaaatgttttttactgagctttattttttattgtgaagcatttcagacagatagtggagtatcgtatactcaatatcagtatgcctgtttcattaagtcataacatgatgccgtattcgcttcaccgtccttttttcatttaataaataaaaggttgccgctcgctgccttccctgccttccctccccagggctgacagaaccccctgtcatgcatttggagttcatctgtcccctgcatggggcgggttacttggtgtgtgttgaatattcacagcattcattgtttcccaggttttaaaacatacataaattgtcatgctgtgttttccaaacagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtggggtatgtacctataaacagcatattaataattctgtgtcatcatggtcccagcttaaaaataatttaggtttcagtaactaaaggaaacactttagtaactttgtcttagaaaagcatttccccctgctccaggcctattatattaatattttcaggtgtacagttattttaatttacagaaattatttatgaatgcctcaatttaaaagttaatagtagatgaaagatatggatactattaaaatatatttaggttttagaagaaaatgcatcaatgactttttaaaactacaaatcattttgtaaactgataactgttttgctcatctgtggaaagaggcatacaattattttctactttagtagaaatctattattattatttatttattcattttttttgagatggagttttgctgttgttgcccaggctggagtacaatggcgcaatctcggctcaccgcaacctccgcctcccaggttcaagcgattccctgtctcagcctcccgagttgctgatagctgggattacaggcatgtgccaccatgcctggctaattttgtatttttagtagagacggggtttctccatgttggtcaggctggtctcgaactcctgacctcaggtgatctgcccaccttggcctcccaaagtgttgggattacaggcgtgagccaccgcgccggccttagaaatctattattaataactaatagatacagtgagattttgctgatgtttgagtataagccaagcaacttaggaataagacatgatcctccaggtgacgaggcgagcctgggaggtcggggcgagaagggagaggttggagctgggatgatgttggcagggcttcctttgcaaacccagagtcagtcttctcagctaaagtcttgctgtgagacatggtggttgggtgaaggaagagtaaccaggcatctgccatgtgaagcttatgaagaaaggaggcagagaaaggagaaccagctccctttactacatagatgaacaatttgattttcccccctcccttcagtctgtggccccagtgtgtataactggtccttgcttcacagccctcactcagctttgctccatgcacagagctctttcattccattttcattaaaacaaattacttgaaatgggtggtggtaaacacccgcaaggctacccaatgtggccactaatgcaccaacagtcacttccaaccacctgtggcctcctcccatgtcctgtccccctgcctggtggcctgaagcaatgacatttctgaagttcctgcttctcgcttcctgacctctgaaacacatgcttctatgtgtcccgcaagaggtacactgtggaattttagttggttttgacttgatgaaaagacatttgtgttgtcagtaattttctgaaattttcatcctaaattatatgactagatgtattcatctgtacatcacaggccacgttgttcattcccttccttcgccatgtcacatctgagtgtggcgcagttcaccagctctgcagatggccccagtgggaagctccgtgccctcagggagtcgggtgtggtgtggctgtagaatgagcaagagttttgttgtgtaactgctcaaaggcaatggaggtgcttcctgtcagccccgggctaattgtgccaaggcctggatgttggcaggcatggtaccctccagtagcaaggacaggtgcagatggcaccaggggagtgtctcaggggtattatcaagatagacaaaggcaaatacttttaattattggagacatttttatgtcactttgttaatctggaactctgtgaaatctatctatctatctatctatctgtctatctatctaatctatctatctatatctgtatctagctatatgttttttgagatggagtctcactgtgtcacccaggttggagtgcaatggtgtgatcttgactcactgcaacctcccaggttcaagtgattctcctgcctcagcctcccgagtagctgggattacaggcatgcaccaccatgctcagctaattcttgtacttttagtagagatggggtttcaccatgttggcctggctggtcttgaactcctgacctcaggtgatctaccagcctcaggttctgggattatagattacaggtgtaagccactgcacccagcctaaagtatatgtgtgtgtgtgtgtgtgtgtgtgtgtctgtgtgtgtgtgtgtgtgtgtgtgtatttttttttttttgagacagagtcttgctctgtcacccaggctgtagtgcagtggtgcgatctgggctcactgccacctccgcctcccaggttcaagtgatttccatgcctcagcctcccaagtagctgggattacaggcatggacctccacgcctggctaattttttgtatttttagtagagacagcgtttcaccatgttggcctggctgatcttgtactcctgacctcaggtgatctgcccgcctcggcctcccaaaatgctgggattacaggtgtgagccactgcacccggccctgaaatcgatatgttaacaatataaaattgtatgcaatgtttgaattaatgttggtggtttctgcctctaagcttagttgtaaaattttgattttaaaatgatgagaaagtagaataattcatgtttttggatccatctttatagttttcaccttcctaattgtgaaaattaagcactagatttaaaacacaattgaatctgatttgaaaaataaggcctcttgtccatgtagagtgtgtgacactagatggagacattgtgttaaggatagagcttggccgtctaagctgactcctggggaagagacatcacaaacagcacacattcttttgggttcttcctatcatagagaataaattgacaccaggaatcatgctgtgcatcactgcgggttcctgcctgtctcctgacttgagccacctttgccagcaggactccagatttgcccttgactccttccataggtgctggaggcctctcctggttgtagaaagccacagccaccctctgctctggtccagtgcggctgtagactcagggtcaggttcaagtgtggaagctgacctctcctccctcagaggagcgtgtgctcgtctggggtccatgtctgctgccagggatgcctgctctgccctggctcccgcggcccacagagtgctgagcacgagttcaaacacctgtctcggggtgcgctgggtagacaggaggtgctcggaccctccaggccttggtgtggacagttgtgttgttgaccttgttggccctgggtggcttggaggtgtgctaagaacacaaagctgtgaattcaaggaggggtttcttcatgtcgttcagcgtcataagcgttcatttttatgctttaaaaaaataccttcaaaaaggaggaaatgaagtgcgatgagaataatttgtagtggattaccacctgcagaagtttatttcacataggatgctgtgtaattggtggctagccgctgcctgcgtgagcgggatagatgtcgttcctgctccctgcatctatggcgggggcgtggcttgtggcaggtgtactctctgtgctgtttacatttatttatcttagaaatcactctagtcaaattcatcgagttgaagatctctaaaaagactggaaacctctgcttcaatttctgaatcatacataccattcattccacaaatgtttactgtgcattattttgtgccaggccctgttctaagtgctgcaggttctggagtgaacaaaacgggcaaacatcaccagactcttggagctgatgttctgttatatccttgaagccctgaacactgctctacttattacatcaaaagctatcaattcaggttaaggggcactgtgagctgccccaggcaggtgaacaaggacattaaattgccatctggatgttaagagattcctgtcctctttctcaatgttttgatgtgcttgcatggtgaaatgaccatatttgtatgttgtggcttttatttaatttttttttttttaagagacagggtctcgttctgtcacccaggctggagtgcagtggcatggtcatagctcactgcagcctcaacctcctgtactcaagcgatcttcccacctcagcctcccaagtcgggattacaggcatgcagcaccacatccagctaattttttattttttgtagagacaagtatcttgccatgttgcccagggtgatctcagttcctgagctcaagcagtcctcttgtcttggcctcccaaagttctgagatttataggtacaagccacagagcctggctgacttttatttttccatttctacaatgccattaatgatcctgagcattaaagctgtggatcaaaatgttttgttttgtcttttaagcatggagatctttttttttttaagataagaaaattgtgaaccaagtctttcatccccatactgacactgacagagtcagtctgtcatgatcaaaacaaatcacattgactttagtcaggctttgaaacgcatttgaactttcttagtcacagaagcatcattcttcgtttacaaccacagatgcacacgtgtctaacgcagttttccatctgaacacggtgcacgcagtgggcatgatttctagggtttaaccgggtgcgggagtgcacagagccctgcgtgtgtattctctggaatcctcccaacagccctttgaggaaggcaccatcaggattgcaggctggtgccccaaggcagagagaagctgagtcacaacaggtgacttggaagtggggagaggggaggattcctcctagtggctccatagcccaaggaatgtgcagcccacaggttaggaccaccttattcaagtttacgcctgagatttcctgtctcggagaagaacaactcctcgggacgatcatcaaaatcattttgtgtcctgaagtgattcatcccctggaaggcattcaacctcggcctcctcctgacaacacacactttggagctctcagaacatcgccccatccagctgtgctacagcatgtcagattcagtgactgacctatggtggttccctgttggtccgatgtgacagccacctgcgctgcggcagtgacagaggctgcatcctggcttactcctcgctgctgtttccttccaggtttccgcagctagggctcgaaagcccattcggaagtgaccaagaaaggccaacagaattcctcatagcccctgcagcccgtgagaagaagacacagccacgcccccaccccccagtgggagcctgaggccacaggcgtgtttaggaagctgtccctgaagacgaaggagccgctcaggctcctgactcccctggccccagctccagttcccctgattgctcatgtccctccctctgtgggaaagaggcaggggccacgctcccctgaccaaccttgccctgtccgctggagattcccatgggccgctgatgcgggccgctgtggcctccccatccctgtcctgcacaggatatcacaccccagccacggggtgaactgctccttcccattcagggcctcctacccttacctgctgtcagccccagaaatggttttaaattaggaaactctagaggataatagaattcgatgaaaaggcccttaagctcttgaaaacgcagtgctgggttagaggcttttaaaaaccagtgctcggtcagaggcttttaaaaaccagtgctgggtcagaggcttttaaaaaccagtgctgggtcagaggcacagcttcactggaagtccagtctctacccccagcacaggcagctgtgcctcagagggggacctcctttgttctgattctgtgtaaaacgggcctattttcatttccatgccagctgagaggtgcccttggggaggtgtgaggtgactgttgaggggcctcatatcatcatgagagcagctataatttggaaactgaaaaaccccacagagttggcatgccgaaaatgcccggaaaatagtgggtgccctcgtgcctgtgctcttcactcatctccacttgaatttcagattatggatcaggtgtaaatacttggttaaaaactaagtgtttggctgggtgcagtggctcacgcctgtaatcccagcactttgggaggccaaggcgggtggatcacctggggtcaggagttcgggaccagcctgaccaacatagtgaaacccccgtctctactaaaaatacaaaaattagctgggcatggtggtgtgcacctgtaaccccagctattcaggaggctgaggcaggagaatcgcttgaacccaggaggcggaggttgcagtcagccaagatcgcatcactgaactccagcctgggtgacaagagtaaaactccatctcaaaaaaacaaacaaaaaaataagtgcagcttgccagtcacctctgcccagcacatatcgcacatgggagaataaatcagccacacagcagacggcagcatggggcagccatgccaaggagagggtcttttggctgttgtgcaagtgactgtgccacccacaggcctttggaattgagaaacaaatgttaagaaatgtgactcgcagcacaagatggagcaagttgccttatgaatccttctggatataaaaattgctgcagatcttattgtcagaaacgttgacatgggtagtgtcatcacgcctttgcagaggaagtgatgctcgagtgttttgatgtatttttccttaaataccgcttcctctgaagccttggaacggcgcgttacacagatctcatctgcctgctccatccacgccaactccttcctttccgactcatccttcctgaggccccgcagtcctgcacacggtggtgacggacttccatttgtgtccagtgtaaaagcaaatcccatcataacaacatgtctttgagagtttcaagcaaggaacatggattgtgaaatacacgactcggctttgagcaagtcctgtcttggggacagtcttttagaggagccacgtgtgcagtggtcctggagcggtgcctgcagctccacggagcaggttctgcacttttcctagagagagcatcatgttgccctgggagctgcactcaccccctaaccgtgccgtccacctcggcagcatcaggtgcagccgccaccagcactgctggcatgggaagggggtggaaatgggaggaactgccccatcaggccgctggggacagggagatcagttctgttcagggctccatctcctgcagccaaatatctgggtcctcagataggcgacgtctgtgccccaggtcttgttcccagagcccgcctggcggctgctagacataataaaatggagtagtcactggggtgagctcagaggcccaccggctgtgctccagtcctggctgggtgacttgggtgattgctgagcccctctgggcctggccaaggtgtctgtctgctcctcgcagtaaccacacgaggtgactgtcattattctcactcccagaggaggacagcgggctgtgttatcagccttgctctgaccatggtgttctgtagggaaggctcattttgtcccatagcctggagcggcctcagagccctttcctgtccctgaggatgtggggtttattcctgacacagccactgtggagctggacagtccaggcctggcttgcagcggccctttccctgcatctgcagctcccccgtgaggatggtgctccaccctggccctcctgtgtttgtttcttgcgcttcccttggaagcacagccctagattcatccctgcaggcgattccccagggatgtcagccacctccgtggctgctgcaagcaggagctctcagtctgccctcacaccccaccccagcagcctgcagggcaccaccctgctcgggaaggtcctggttctcagtcatgtttgccaagcgatgtggtgtaaatactcccactgctgctgagttcaggctgccaaggtgaagtcctccagctcacacaactgctggaaacttagcagtaggctcatgagccggctccagcacagcaccgggctccgaggaaatcctgtgccacccgccagtccttgtccttcctgtcctgtcctgtgtgctttgacacaggagattgctctctccaccaggaaatgcttttcttcactcaccagcagcctccctcctggctgcgcctttcaagtccccatgctggtccctcatctccccagctcttggtggtatagcgtgtccatgcactgtcctcccacctcggcaacctcgtggggctcggctgtatacaccgtcctgctcgtatacactaccccacccatgtataccatccccccgtgtataccatccccctcatgtacaccatcccgctgtgtacaccatcccgctgtgtacaccatccccctcatgtacaccatccccctcatgtacaccatcccccgtgtacaccatcccccccatgtacaccatcccccctatgtacaccatccccctcatgtacaccgtccccaccatgtacatcatccccccatgtacaccgtccccaccatgtacaccatccccccatgtacaccgtccccaccatgtacaccatccccccgtgtacatcatccccttgtatacaccaccccacccgtgtataccgtccccccatgtacaccatcccctcgtgtacaccattcccccgtgtacaccatcccgcccatgtacaccatctcacccatgtacaccatccccccgtatgccccatccccccgtgtacaccatccccccgtgtacaccatcccctcgtgtacaccatccgcctgtatgccccatccccccaccgtgtacaccatcccgcccgtgtacaccaccccacctgtatacaccaccccgcctgtataccccatctcgcccatgctcccaagtctcctccgtgagcgctaggcctactaagtagccacctgagtcaccagttccactgggcgcctgacagacatgtcagtggaagccaccccaaactcagcttctctctggaacttttgcagctgttcaggcaccaaacattggaaccacttttcatggttctgtctctgcccacatgcaaccaccagtgagttctggtaactccaccttcaggagaggctgagtccggcccttcccaggcccctggctggattattccagcagcctccttgccaggttcccgccttccaccctcctcaccgggttcccgccttccaccctcatcactgggttcctgccttccaccctcatcactgggttcttgccttccaccctcatcacttctcttcacacatcggcagaaggactccttagaaacactctacagtgctccgtctttgtttaaaaccctttgacaccttcccatagaccccagccaaagcccaagtcctccctgggtctgtaaagacctccgtgatctgcccccaccccatcccgctgacctcatttcccgcatccctgcctctccatggcctgctctagctacctggagctcctggctgtttctggagcacacagaagtgcccctggaattctcccagcatcccacatgactggctccttccccctgggtctgtgcttacatgctccctgctctgaccgtccctgaccacccgattgaaaatgtcatcctccaccccggcactgcctgcctgctgctccaggcacgccctcttccagagcaccctagaatccaggtgttgtggctctcccacttgactgtgatctccacatgagcaggcgttaggtgtctgttcactgctacatcctggtgtgtaacaggcacttggcaaacgtggagggaatgaagggctgttgccatgtgtgtgtgttggcgaggggggttacgtttaagcagccacctgtgtgagctcaccttcatcagtaggcagcgtgaccatccaggcaggtatgagatagccactctggcaaggacggccttcacagaagggactcgaggtggggactgaggggagggtcccataggccagctgcggaattaggacacctgcccccacagcttaccctggccagggtgttgaaggctgcaggtcatgatgtcttggtgcagaaggagaaaaggagacctgggctatgtgttctcttttgaaaagatagtaatcttatgttacatggttctcccaccttcttgaaacaaacacacaaacagctcatgttttttcaacaaggatgaattgagcaagttggaggtgggaggccatgggctggccctggggagccctggtgcccaggccctgcagttccagcgccatgcagcctctggtctcatgaagacgaccttggcctgttagctgccccccacccccgcagggacttggctgggagggcaggtgctaaaagtgtctgccgtgtggaggcaggaaggctgctcagaggatgggctttcccgctgaaagcagagggtgggctgctgtctgggatgagcccagcagtttggaagagtgtgagggagatgaacggtctcagggaggaagtccggttgctgttctggagctgagacagagcccagagccttctgtgtgaacagggagagagccaggacagagcccggacagagccctcccttctgctcggtgggcaggcattggcagacacccagggcttccttgtaggcatgcaggccgttggctgccagccctgccctctgcaggcagcacctctggctggtggcagagttcattcagcccctgggcacgtccccgggtgtgtctccgggccagatggggctgcacagttctgcattagcttaggaagttggttttcaagacattgatgcttccttttgtctgtaacagtcatttctattttaatagaaaataagatctgtgaattagaattttttcctggtcaattgcaccccattcgaacctttccttttcatttttcattatggcaattgtacattcacctagttctcagttcagatggagcacatactttttggagaatttctgtcaaatatgctagagtgttgattctgctgatgcctgctttcaatgtgagtgatgccaggagtaactgtttttctccccacctggctgtggtgctcccagtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatgtaagtatgcaccctctctaggattcaggtatgttgaccatgggagaatttcctgtttcacttcccccttgtagggaaaaactcagtttttcctttgctctctcaccacaacaataatcaacacagaagactgctatgatcaaatgtgtggaggtttttcctcaccaaaaagcaagcaagtggtcctgcagcagacaccagctgtgcattctcattccgtctctaccctgtctacctggagatagcctgagatcccacaggttgagggttcagtccccaagactgcccccaccctgccccatttctgatgctagttgcaagccccaggttattttgcctgtgcttctgaccgactggctctaaatcagggttcccacaacccctccttgggtcaattaatttgctagaatggttcacagaactcagggaaacactcatgtttactatttgattacaaaggatattttaaaggctaccaacagtcagaggaagacagacaaagggcaaggtctggaagggtctggagcatgggggcttttgcccccatggagttgaggtacatcccctccctgcccgcaaatgagctcttgttcaccttcctgttggtctcgatgtgtttagcttccgggaaactttctaagccctgtccttttagggtttctttttcctggaagctttgtgattgattaaatcattggccaatagtgatcacctaagccatcagcccctctccccacctccaaggttgggctgggctgaaagtcccacccctctaatcctgccttgggctctccagtgaccagccccatcctgaagctacctgggccatcagccaatcacaagcataaagaaagaactcactttggagattccacagattttacttgtatgccaggagcgggggttgaagaccaaatatatatttcacaatatcacatcccttgtctgcaataactttgtcccaacgaatcccgtgtttggcagaaggtttaggcacacctgatagtattcagggtgtgtgtaagtggagccgcagatcaaaggccatcagcgaaagcaagcagcacctcagaagggagcccgacctctcccgtggctcccacccatgtgggctgaggctcaggtttttttagactttagagggagagaatgtatcttgtcattaagactcatttatcccagatctatcctgattcctatgtacagcatgtcaggtggtactaaattgtagcatgttaaaaagtgagatagaggctgggcacggtgcctcacgcctgtaatcccagcactttgggagtccgaggcaggtggatcacttgagatcaggagttcgagaccagcctggccaatatggcaaaactccatctctactaaaaaaataaccaggtgtggtggtgggtgcctgtaatcccagctactcaggaggctgaggcaagagaatctcttgagccctgggggggcagaggttacagtgacccgagattgtgccattccacttcagcctgagcaacaagatcgagactccgtctcaaataataacaacaataataataataataataataataacttaaaaagtgagatagaattcatttctccacaatgaaacgtagacatggattactgctggtggacctcctgacagtagtgccacggatgcaggatcatttgcagaaacttgaggatgtcattgacatcagccacgcaattctcactctgatgaacttgctatatgaccccgacacattgcatgttatgttgtatttgcaccaggctgcatgtgatgtaaggctggttctgctctgaagcatgacttggagctaacgttggaatatattgtccagtgttctgatcacctgtaacatttttaaacaagattaatgaatcctccctttaaagacaagatgcagagtaaaaaggaacaaagctcttgggtcctgcggaagttctcatttgttcattccctaaaccatcattgggtgctgactctgcaccctgcactacctatggggaggcagagagagcagcccagggctggtggggtgggcagaggtggtggtgacaaccgcagggtccggggagctgtggtgctgcagagtaagcctggttaacagcaagaaagggccttctaggtgcaagggcaggaaagggcccaggtcctccaggctccagccccaagggagatggggtccctgaggtcttcccggcacttccccttgggaccactgccccccaagtgctggttatggtttgtccctgagccccacacctctcatctcgaattgcccacagtacagtttattgagcacctgctctgtgccaggcattggcgcaggtgccggggatgtagtcagtgaacaggtcacgccctgacccctggagttttgccctgtggagcagacagacatcagacaagcagattttaagacagtaggtcatgttcagtgccaagaggacagtaagccagggatagggaccaatgggggctggtcccagggccgccttctggcacagcacacacccctgctcgcctcagcctcctgagaagccccctggcctgtcatcaccacccagagtcttgtcccctcctcccaccctttccaaccggccatgatgccacctaggatgcaggccacagcaccaggagctggcgctcaagtgatccgccagcctccgcctcccttcctgtgccagtggagcctgcgttctgtgccctgccccacctgtcccagccgtcctcgtctccttgtcccttccacatcgtttcctctccttccttcaaactcacatcccctctgcccaccatgggctgagcctctggactccatggtccctctttttcctccttcctctgtcatccactgtcactccaaccctcctgtcctcgtggaagaccgcagctcccaagccatcccttctgtccgccttattcttgacaccatcctggctggtgtctgcagtcacatggacgacacagtactttgtccccagctctcctcctggtgcccacagcctctgcttctgcaccgccatccgggtcatgctgggccccttctcctgcccgatccgcgcacctcttctcttcttttgtgctctctgatgcggctactccgcctgacagagccacctgggacatgggtggttccatctcattccaaatccatgtcccaagcctccaaagaactgggaccctgtgcagcagccacttctcccaccactttcctgagatcacaagtcatcaaaaaagaaaaacctatgcatatagcacccatcttttcacctagaaataaagctacatttattatacgttttggtgcactttgcacaagaaaatagaatgctttatttttggaagtaagaattactgatgagcaaccataaatagtttttaaaagtagaccttttaaattatatcgcattttataaaaatgttactaagtatatgatgagaaattaccaataaatatctttatctgtttccaatttagagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcacacacctctgtagtgtgagtgtttctctaaatgggaatttagtgtgactgcttcgtggggcctgattcatgattgcttttcactgtgtcttttagggaccttaagtgtaagaagttgataacagtaaaatgatctcttttaagaaaataatctatttggagactgcagagtcagaagtggggctgggcagtttgaaaagtggctttttgggccgggcgcgttggctcacgcctgtaatcccagtgctttgagaggccgaggcgggtggattacgaggtcgggagatcgagaccattctggctaacacggtgaaaccccgtctctactaaaaatacaaaaaaattagccaggcgtggtagcgggtgctgtagtcccagctacttgggaggctgaggcaggagaatggtgtgaacctgggaggcagagcttgcagtgagccgagatcgcgccactgcactccagcctgggcgacagagcgagactccgtctcaaaaaaaaacaaaaacaaaaacacaaacgaacaaacaaaaaaaggggctttttggtcaggcgcagtggctcacacctgtaatcccagcactttgggaggctaaggtgggaggatcacttgagtcagtagtttgagagcagcctggctaacatggtgaaaccccgtctctactagaaataataaaaaaattagccaggcgtggcggtgggcacctgtaatcccagctactcaggaggctgaggcaggagaatctcttgaatctgggaggcggaggttgtagtgagccgagatcgcgccactgcactagagcgagactccatctaaaaataaaaaaaaacaaagtggcttttcttcttcttgactccaagctggtggaggggctcgccctttgctccctgcctacccctcctaagactccctgggaagggcattggcagctgaggctgcatcttttctatgaaaggtggaccccagggaccctgctgcctggcctagcgtccgtggctgggggaaatgtactggacagcagcgtgatccacttgaatggaaataagcatccaagatcctttatttgctttccttttataaagttttcgaaaaggccaataccaatgaatacatttcaggttagcttccaggccagggctcaggccctggagaaaactcgtgcgaatgcctgtctggggggcccaaggagcgagtgtgggcccctctaaaacttagagggacagattacatgacgactttggggacagcttgctaagtgtccatttggcagcatctgggatgagacgtgctttcactgtgactatcttgttgggaggtgatggggaggggaaatgaagcccctgcctcctctaaccctggaggctgcccacgtttaccaagagaatctcacccaatgctgaccagctcagcgtgcaacacagcatcactgggctcaagaaaagacatttgaagacgagttttgtaagcccgagcataggtgaatatcaccgtaaataaactccaacgtgaaaatctgaatgtataaagcataaatcaggaacagcttttcactcaatcaaaaaggcatgtggtgtttcagtaataaaaagcatgaagtgtggagacgcgcggcagcatgggtgtgatgaggcccgtccctgctggtgaacaagtcctggcctttgtcccttgaaaaggcttttgtctcaaaaagtgggttttcttgggaatgacttggtcatagaaggagaaatagcattctgtatgaatcggtgagggctgccagaacgaagcaccggagacccagtgcttacgtagcagaaacacttcctcactgtttcggaagcagaagtccaaggtgaaggtgttggcagggctggtttctccggaggcctctctccgtggcttgtggttgctgtcctcctcctgggtcctcacatggtcttcccttgtgcctctccgtgtcctcgtttcctcttcttattagaacactggtaatattgttttagggcccatgctaatgacctcatgttaacctaattaccttttaaagatcctgtctccaaatacaatcacagtctgagttgctgggggttccgacttcaccttgtcaattttgttggtggggactcaagttcctccgcgccacattacttctcccagccctcagaatggttttagcctgacttggcaagtgagggctctgaagttcaaacagattttcccatagaaacatgcactggctctacaggtataaaaagaaatgtaaatagaaaaaaaaaaaaaccagaaacaaaacaaaacaaaacacaaactggccttgtctagttgacacaaaaccaaaaagtatgtgagacagatctcaatcaacttcgaagtttattttgccaaggttaaggacgtgcctggaagaacaaaaccacgggatcacagaggcagtctgtggtctgtgcctttctccaagggtgatttccagggcttcactgttgaaaggggagaagcggtctggaggcgggaggggaggatgtggtcattactgaatccacaggctgcaagggaaaagttgcagacagggaatcgtcagttatgtatcttatggtctcgtgctcagtaaatctgcgcttcacccaagataaggtgaacccagagctgctacctgaggagattttaactttttctctgtagctctgtgctgaggagcaaaaggaaaggcagcttcctgcatgactcagcttgcagcttcatttgttttccttctggcagagtgaactggggtcccaagtttcttttttcctttcatgacaccgtctgaacacctgtgtcgtctcagagtagtgaccaaaatgccaaggcctcattcggaggataagcactcatctgcccagccagacccaaggttttcagaacactccttagcgtggactctgggtctggagcagagtggaggtgggcacccaggtcccgtcccctgagtgctgggccactggccggctcagcatgagactcagacgcacagcccttagatcacccacacatcggagtctcctgcttaacgctctgtccctgtccctcccccagcacagttgggggtcttcgtctggttcctggtcactctcggctcagctccagcccccaggggttgtccctgcctcacggttgactgtcaccattggggctccaagtgcccagaggccgagctccatcatgggtggaagatgagctaattttgtaattaacaaaacataaagggggatcactctccatgccatttagtgggggagctttaaatatcttgctctaacacctgattaatgtgccatgcttctgtgagcaaaaagtggattgtttgtgcctcataaaccggattcctaatcccagaatactcaggcagagggcttcctctcatcaaggaaaacacgttccctattctgttgattttgactcttcttgttacaaggctgaatcatctatgttccccttcatagcctgcagttatttcttgttaaaatagccataggtagttgggctttcagtcagattgttgcttgtctttagggggtaactcaaatggtttatttaataactacaaactttattgcaaatatcattaactggtcaagatgttgaataaaataaactgttcaggtggctggtgtgtttgaagaaagtagctctgggaggagaacagcagaaactcccttgctgcaatgaacatgggaggaggtgcctgaggaccctaacgggattgataggggctccagtacaataatgggagatttgctatcacgtggagaggaggccacatctggatttagcacctcaagagtcaaagacaatttttccaattgaagtcactttaaaaataaactttgggctgggcgcaatggctcacgcctctaatcccagcactttgggaggccaaggtgggtggattacgaggtcaggagatcgagaccatcctggctaacacggtgaaaccccgtctctactaaaaatacaaaaaattagccgggcgtggtggcaggcgcctgtagtcccagctacttgggaggctgaggcaggagaatggcgtgaacctgggaggcggagcttgcaatgagccgagatcgtgccactgcactccagcctgggcgacagagcaactttctttaaaaaaataaaaattaaataaactctgaagatgatggagcgtttgctggcactgtggctcatgccttaatcctagcacttctggaggccaaggtgggaggattgtttgagcccaggagtttgagaccagccctagcaatggagtgagaccttttctctacaaaaaaattaaaaaaaaaaaaaaaaatcagctggaagtggtggcatacgcctgtggtcccagctacctgggaggccaaggtgggaggatagcttgagcccaggaagttgaggccacagtgagctatgattgcatcactgcactccagcctgggcgatagagtgagatcccgtctcaaaaaaagaaaaaaaagttcctggcattcatacggtgtgactttgaaaaacacctgcttttccttaattgcagtgtggggaggggggtggtgggaagcagaattgaaaaagctacaagatgcagatgagtggacagtggttttatcttatgacttaaagaatgctctgtcccattgaaatatgtgtcttaagtctttgtccaggcagcaacgagtggcttatttggtttcaagctaactttatttgttggcttctgtatttttcatctctaaagaaagtggagtatatttcttctgttggtttatgaggtataggaaaagaatgaaagcagggatgactccagaaatacgtgcttacccagcatggtggagttctgaggtggctgggcagggccaatgatttgcttttgaaatgattgtgctaagagtcacacattgaatttacgattagttgttatttcttggcaatcactaacatacttgtgaattctcattgtgtgagagaatctaacttacaaatcgttttcaaatgtagtgagatttttatgtatactaaatttagcaattaatgaggaatgaacacagaaattaatcatttattgagtctgattttgctatttccgtaatttgcagccaataatttttttcaagtcttaaacattctcagaggtcgatgaaacccttgtcagcctgcggctttgtgccttagcatctcaagaatgaaatgtgttcaggtcccccgtcctccaaggaaaatcccaactctattatgttgctttgtacaatttgtacaattgtacaatcccctggttattgaaggggatccccaccaggaccccatgaagtggacagaagtaggattaaccccctttagaggggactggcctagaactaagatgccaggggcagccaggtcctccttctgcccagggtccaggcccacccacctggcctcacactcctgtccctctcaactcttccatccaacagcattccccgtatctgtcccatttccccgttctggcttttggtaaggccagaagcccccacaggtgaaagaaactggataggtggggttgggttgatgtccactgtttcctggaaccttcatgctttccccgaggttggagcagggatcccacgctttcctgtgctgagttggagccagttggcctgggatatggaatggctttctgggcacatgtcccacctcaaaccccagtcccattcttgaatctcacgtaaagtattagcagggcgtgatcaggagagccacacagcatccatgaagtgccctggccgtggggcctcggggccggaaggacatttgggttgggataatattcgggcttaggtgaaaatgcatttacccagcacctgctaagggctggcccccctgccacgtacgggttttgcagctaattaagttctcatcccagtggcagggaaggctgctgtcattacccctgtgttatggaggcacacttccttgtccaaagtcccccgggtggaaaggcagggactgttactgggtcctggcagtccgactccagagccttggagcccaactccaaaggaaaggtgaagagtaaagtggctcttggggaggggacagtgatgagtgggagaatttgttccttgattctcttttcttttcttttttcttttttgagatgaagtctcactccattgcccaggctggagtgcagtagtgtgattttggttcacctcaacctctgtctcccaggttcaagagattctcctgcctcagcttcccgagtagctggtaccacaggcacaagccaccactgctggctaattttttgtactttttttttttttagtagacacggagtttcaccatgttggccaggctggtcacaaactcctgacctcaagtgatccgcctgccttggcctcccaaagtgctgggatgacaggcgtgagccaccatgtctgatccgtccttgattttcaattggggaagtgtgtaggtggggcggcctgttaggaatactggaacagggttttcgaagaaggtttcaaggagactgcttactaagatatggggagggctgaggggagcccacaagggagggtgcaggcccctgggctggctgcggtggggttttatgtcccgcagcctgaaagtgcaggagaagctgttgcggggatccacagagatggcagggctgaggagagggctcttggtgagagctgtggctttagtacaggggtagccaccccccacatccccccagggaggtgactgggggataaataccctccttccatttgtcttccatcctgggatcttccatcagggtcttgtcctggctgagcacaaccagaatctggagagaagaaagcctcatgatacacaggtcagctatgctgggctcagagcatggaagagccaggagaggctaaaggaatgtgctagacaaagaagtttgaaatatccagcacacggccattcgatgaagacatggtggggtccagcacacggccattcgaccatttgggtgaagatgcggtgggggagactcatacctccacatattcatatgcatgctcacagtgcatacgttgtttctggaatgatacacagaaaaaactggtagaaacctccaaggaggagaagttgggaggaaggctgcctgtgtctcattgtataacttttttctaccatttgattttcacttgtgcatttattatgtattaagtccacccatcaaccgtgcatttattatgtattaagtccacccatcaaccatgcatttattatgtattaagtccacccatcaaccaatcatgaaaaagaattggtgtctgagttctttgggcttggagtgtagccaacagggaatgcttgtgatctaggctgggcccatcacagtgctcccctcctggccaaagtgatttgcccaagagagttggcacatgacctgcacttgacggatgagagccttctctgggtttttcggcttggtgctgggagagagaggcccttttcttcttcctttgattaaaaagcttattaggatatgggtctagagttgtaggtgctagtagtcactaacatacgtgacactgttatgttgaaacatgttagctactgataatctcaaattttcatcccccaaacagcaatttcatctagctcaaccccatacgtgccaggcctcaaggagagtggattatacagggcgtgttcaccaggagggtggggatttgggggccatcttagaattcagcctgttttccacacgctaactcatttactcttcataaccatgttatcaagtggaaattattgttattaacctcatagccattatagataggtgaagagaaagagagattaattaagttcctagtccaacaccacacagtggtcctgcttgccctgctctcccagtctgctgtgagcccagcatggagcctgtctacactaacggggtgaggaggagaggaaggcagagtgccagggttcccaggggctaggatcatggttcttctcctctctaaggccagcaccacctcagctcagctctcaatttagttagacccagcaggcaagtccccctccaggcttacacaatatcagggtgaatacctggcctttgcaattgatttgacctgactttgaaatcagccttttccctggttgtagtcagttgaatagtgagtgactcccagaaagatatgtccatgtctcaactctggaacttacaaatgtggccttgtttggaaaaagggtctttgtagatgtcgttaatttaaggatcacaagatgtgagcatcctggatttagggtggaccctaaatccaataactggtgcccttaaaagagaaaggcagaggggagtttgagacaccaatgcaggggagaacaccatgtgaagacagagacagagattggaggaatgctgccatcactaaggagtgcttggagccaccagaagttggaggaagcaaggaaggattccctcctaaaagcttcagagggagcagggtcctgccgataccttgattttggacttacggtccccagaactgtgagacaagaaattgttgctgtttgaagccaccaagtttgtggtaatgtgtttcaacaaccctaggaaatgagcacacttattacctcttttcttgcaaaccaagtccaaaggggacaccagaaatgggacagagccctgaagcaagacctgggtttggttttcttttgattccgaaaataacagccctttaaggaatcaagaggttggggagaggttgaggctgaagaaagttgaagaactgaaagaatcttggctcatttggaggataagagagagttctagaatggagagaagatagacctgctctagaaaaattttctggctgggcgcaatggttcatgcctgtaatcccaacactttaggaggctgaggcaggtggatctcctgagtgcaggagttcgagaccaccctgggttacatggcaaatccccgtctctactaaaatacaaaaaattagctgggcgtggtggcgcacacctgtggtcccagctactcaggaggctgaggcacaaaaatcgcttgagccccggaggtggaggttgcaatgagctgagattgcaccactgcactccagcttgggctacagagtgagactgtgtctcaaaaaaaggaaaaaaaaaaaaaaaaggaaaattttctaatttccacaggttttcaatgagtttctgctgcagacagaatcctaaggtggctttcaagattccgtccactggcagacacgccccattgaatctccttccttgagtgtaggtaggtctgtgtatagtcaggtacacagcgggacagtacatggtgggacaattaccccctcgattgtggtctgtgacatgactcagcagtagcagactagagaggggttctcacactggctttgaagacataagctgtcactgcgagggcaccaggtgctgaggacatgaggatggcctctaggatttgacagtgacctccagccgactaccagccaaaaaacgagacctcagctctacactgccaggagctgaattctgccaatgacctggatgagttggaagcgaacctagagcctctgttgagattgcagcctcggcccacgccatgatgaggtttcttgccaggtgaacagaggactcagccaagctgggcttggacgctccacccatggagaaggtcagatgatgaatatggatcatgttgctaagtttacgatactttgttatagaacaatagaaaaggaatgcagtttctgaccaaagttcctcccaaattgtaactgaataggagcggctgagcttgagccttgattttgtgcttttttgctgatttggtggttttttatgaccaagtattaaaaatgggtgtatattttaaagtcatgttttgagacaaatcacacagttaaaaaaacaagtttaaaagtctctaaagaaaatagagaacagatgggcaaaagttgatcagtggttaaacataaatgtgttccagatgggaatggaaattgcttgcttattattgttggtgtggccagcagctcccttcagaagcctctcaggtggctttgtagcagaaaacctccagaaagacatctttccagggacgcctttccctggtgccatctagatggcagacttctagcaagttccgctagcagggcaccacagccacttctctgcagttctacaagccacagtcacaccctcttcaacaagacctggatctcagctcagggcaaggggatttctctgggtgtaccattccagtccttggggtaatggctgttattcatatctgctattcatatattctgtaaaattatctttacttcttgccagccagttcctcgtaccccgaccctattgtccttactgattatttatataaaactttccctgttcaaatcactctgtggtttctctctcctgattggacccagactgatgcactgttcccagcagcaagtagcactatgtgccaagcaccaggtgataatttcagagagctgaagtgacataggcctgtctccaaagagtaaacataatgcccacttcaacacttgagaaaagaagggagaagtataaaataaaatataaaaataaataaaaaataatgcccaagttaagcagacagagcatggggcaacagggtaagagactgggttccagacctgattctgcaactaagtatgggatttggggaggattgtcccatcgctctgtttcctcttctgtaaactacagaaagtaatggactcagaggctttctattagagtaaagctaagctgcagtaacaaagtaacaaatcacacagtggcttaaagcacgtagaagtttattttctctcaaataccagtcctcagatgaagggtccttggtgatggaactgctgtgctccacatgatcattcagggatccaggtcctgtccatcttgtcgctttgccatcatatggactttcaccctcatctgcatgggtgcagttcataggaaggtgaagagcagggaggaggccattgtcttaaggcccatacttaggagtggtgtctattacctcccctcacatgccggcaggcggtgcgcttagccacgtgaccacattgaattgcacagcaggctgcgaaatgcagtctctagctgagcagccacatgcccttgatcacatggaagaagtgagagcgtgttgagggggcaactttcaatgtccccaactcctgttccagctctgccagacccctctatgtgttgcggggcatgattgcgtgtaaactccagaccatttaggtaaagaaggaaaacatctctggcaaggtgggaaatacgtgcctcatcattctgcttttgcatttcagaatcaagatctgaagagcttgcaaaaaagttcttttagtgctgaaaagtaggaacgtggcagatgtgactaacaaaacagtccttgtgcatctgctagggagcacagattttctttttttctccaatataacaaattacaatccatctgggatttgagaagtctgagctaaggtttctggatctgtttgcatgtggaacaacgatgaaaagaagaaaatgataagtcagttttaaagaacttttcttgtgtttcaagtggaaagaaggcttgagaatttttttacattttactctggtgtagaaggacggtgatatttaaagagttagaatgagcattaaaacaaagacatgaaaataatcgaacccatcaattgtatttttatatgctggcactaagaccttaaaaataataatgtatctaattctcacaaaaatatgttaaaatgaggactatcatgtccattttaaagagacgaaatggaggcagataatttgtgtaaagtcaaacagctagtaagtcttggatctgggagttgaagttagatcatttggctcgagtctatcagagacctgcaacccttttctgtagtgcatcatatagtaaatcttttgggctttgcagacatgcagtctctgctgcaactgctcagctctgctgtgtagcatgagagcagccatagacaatatgaaaatgagtgagtgtggccgtgttccaataaaactttattaatgaacactaaaattaagttcatagaattccacatcacaaaatatttttctttttgaactttttcaactacttacaagtgtaaaaaccatttttaccttgtgggccattgtttgctgaccccgggtctatgcagttaaccttgacctttttcaacatgttaaagaggttaacccacatttaccgagggccactgacctgggcactgtgtggggcgctccatgtcctggtccacggacttgctagtccacagacttgctaccttcatctataggtagctcctgctaccgttattcacactgtatagatgaagaaagcaaagcggtcctactacaggtggaacaaggacacgcagccagccaggaactgagctgacatctgttgatggacaggaaggaaggatttgggtcagccatcaagactctctcaggacctgaggaaaagggcgggaaacttaggagcaagatgacaggagggcagatgctccgtgaggatggcaggaagaggacatgtatgcttaatattctggaaaatcctctgggataaggccaggcacagtggctcatgtctgtaattccagcactttgggaggccaaggcaatcggatcatttgaggtcaggagttcaagaccagcctgggcaacatggtgaaatctcatctctactaaaaatacaaaaattagctgggtatggtggcgttcacctataatcccagctacttgggaggctgagacaggagaatcacttgagcccgggaggcagaggttgcagtgagcaaagatcacactactgcactccagccttggtgacagagtgagattctgtctaaaaaaagaaaaaaaactattcaaaatcctccaggataaaactctctgttgaaggaagctttaatcagcagcgagcacatcaggcacactcgttgctgccccttctcatcccgcattccctctgctttggtcaggtggtgccctccttccatgggtagagccagagatggtgggttctggctggtcagatgggagtggacagagacccggggtcctcccggcttcatgactgcacgtggtgggccctgcactgtgtgtctactgggatggatcaaggtgcaaccagagaaaccttgagccctctccagatacttgagtggtagctgagttcctgcagcctctgtgagctcccttctgagcctctggctcccagtttcccagtaccctttctgtattagcttcctggggctgccccgacaaagtatcacaaactcaggggcttccgcaacagagatttattctctcacagtcctggaggctagaaatttttggacttctagcttcccggacttgattggcagggccacacttccttctaaggctctggctgggggtgggggtccttcctgcttctgccagcttctggtgatgctgacaatccctggcattccttggcgtgtgggtgcattactccaatctctgcctccctcttcacatggtcttctctgtgcgtacgactgtgcatcctctcctctcgtaaagggcagcagtcgttggatttagagctcaccctactgtggtatgatctcatcttaatgacatctgcaacagccctgtttccaaatagggccacattctgaggttctgggtggacatgaattttggggtgggaaacactcttcaagccagtaaatcttcctccccaaatcttgctaggtttccaatgcctaaaagaagtgctaattggagaaaataagaatagttttctacttatctcaggagcgggaaaagatggcaaaatggcatggccaattttggaaagaatatatagggtgttgtaaagatatgtgatgatgatgaggatgatgttttcaccaatatttgcagcctcttgtccacacagaaggattaggaagattaatgccttcgaaatcagctatattttagcactctgtttttagtgttttcatgattatcctggtgtccttgtttttgaggtggctgctataattatggtaacgtgtgtgagtaggttagaaagatgttacaagtgattaagctataaattagtcactttggagtgtgtaatagttctttcaagtccccagcatataagggaaagtgacactggtctacaatgactgtctccatgcttccatgcagaaattgagacctggagaatgtaaagacttgcccaagttctgtgagtgagtcagtgctagaaaaatcttgagcccagccccccagatgtgatgactattctctttcaaatatttctacaggattagaatgggcgctcaggcttggctcagacaccccacatctttaggtgagtggcttttaaattgccatttggtcacgcctacttggcagagttgcaaacacgggctgcagagttcacacccgcaccctcctctctggaagtggagtgagaacagggtgggcagaggtggggctgccacacctgcttccctggaaacccgagggagagcacaggacgccaggctgggactcggctggcagctgcttcgggcgtctcaccttgtgactatttcctgggcactgtgggagaggaggcctcttgcctgagctcctgtccctactgtctcctctcactaaatgcacggcacggctttgcggtaataggctgggacatgtcaactcttttttttttctgagacggagtttctcttgttgtccaggctggagtgcaatggcacgatctcggctcacgcaacctctgcctcctgaattcaagcaattttcctgcctcagcctcccaagtagctgagattacaggcatgcgccaccacgcctggctaattttgtctttttagcagagacggggtttctccatgttggtcaggatggtcttgaacccccaacctcaggtgatccgcctgcctcgacctcccaaagtgctgggattacaggcatgagccactgtgcccagccaacatgtcaactctttaggagagtttgaagacaaaaaataacccatgtctgagcatgggaggtgctaaaaataggaacttcttagcttccacaagggcagataaatgaataaataggccataaaccaatgtagttatttcagctgggggattttattttcttttgattgtcccctggagctacgaaatacacaaatatagactgatagatttttttcattaattcgaaaagcatttaatggctgtcatctatgtgccaggcaattgatgcgcagccagacttccaggaggctggagggggatccagatgaacctcccggagtaggattgtcaggaggggactggagaccagggccatcctgaaaaccccatctctgttccaggaaattcctaggatcccctgggaggcacagcctggagaatcctattttggttgctgaacagatgcacacattggaattgagactgcgtgtgcttggggtgggtcggtgaggcgggggcagtggggtccaggtgggagccgtatggaagccctcccctccccatcctccaggcatgccagcgagtgtggccttatgttgagtgtgtcctccagtgtgagtggctcctccgagtgtggtccaaggacccgcagcatcagcatcccctgggagagccttggaaatgcagaatcttgggatccagctcagacccagtcagaatcagatttccaggcagctcgtgtgctcattgatgtctgagaggatctgcttgagaactccacagctggggctgacaaatccccctctgacctcaaatttacctcctccttctaaaaaagccagacaacctagctccctgcccacccacagctctttccagtggatccaacttcctctcacacccagtttgagcagggggagacaggaagggcctcttctctgcttccagatcgtctgtttcttccgtcaaacaccacagttcctatgaaacccaccgcagtagcagacctgggtcttgtcaagagctatgaagggtctgagattttacctactcctaggctaaaagttagcctgccagtttgacaaatgctgcctaatgacacgagactcccggggcagagacaaaggactttgctactcacagcacagcaagcagcataagttttgctttaaaatgtggtgtattaatgcaatatttgagttatagtaaggccaacagatcaggaaatgattgtcattgaaaggacagtttgttactcccagttcccaggaggaggggccacgctgagctatgcagggccacgagcgttgttagcaggctcaggagacagcggacatgtgggcaaaagccttgtttgtgtccctagttgtccggtacttgctcccagggtgattaggcaggtggatagtggcctggagtgtgaaaacccaatagaggaggtgtctggggcatgggcttgcaactggttggtttgcatttgaaaagcatgtttgcaggagcctggtttactatctctggggattggttagtactgggtggggcagtccctccagggtcagcaaggtcccagatatcaaagcatcagaatgcagagaatggaagacatggttaatacaagcttaatgtttgcactggttccctatgtccccaaaaccccatgggggtgacgtggggggcccaggtggatgctgccgcgcagtgaatttgcatcagcgagggaaaaccctgagctcaggggatgcagatgctttataatgggcagtaagcaaacacacctaacctttgtcccagcgggagatgttatctttataatattaggtaataaccaaacctgctctctgctctgtagggagacaccacctctttgcttctccaaggctgtttgctgcatctgaaaagacaatctggaacaagaggagagtcaggccagccacagtggttcatgcctataatcccagcactttgggaggccgaggcaggtgaatcacttgaggtcaggagttcgagaccagcctggccaacatggggaaaccctgtctctactaaaaatacaaaaatcagccgggtgtgatggttgcacctgtaatcccagctactcgggaggctgaggcaggagaatcgcttaaacccaggaggtggagattgcagtgagccaagatcatgccactgcactccagcctggtgacagacgagactccgtcaaaaaaaaaaaaaaaaggttaaaatgctacactttcttatcatagtttaccgcaattaaaaatcaaaacaaaacaaaacgaaaaccgtaaaagataaaccttttcgaatgctactatttcctgtatcataaacagttcctcttaggaaggcctttctggtatattaaagacctgctccagaaaacacaaagcggatcagaaaaacaaaaagtggatgtcactcatggacattttgataacatcaatgtcatgtacatttctttcccataaattctggggaatttttaagtggcatgtggggctctgaaaggttaggagagatcaggttttaggggagtggggaactctgatgtaatggtctaatggcccaacaaacttgggtgccagggctctggcatgagggcagagaaagggctcttggaactggggtcctggtgggaaggggagggatggacacggtagtgggtagaataatttcccctcaaatttcaggtcaactcggaatctgtcaatgtgaccttactcgaaagttctgtctttgcagttgcaatcagtgaagaatcatgagataaaataatcttggatttaaggtgggccctgaatccaatgactcttgtccttatatgaagagaaggatgacaacacggagtcactctgaaagctcagcgtggtagaacttagcagcatgatccagctgtgaggaagcagcttccaggtgtgctgccagctgctgacctagggggttcaccaagagggcccctccctgcccagtgccctgactctggggtccagggctgcacacttggatgacagaaggacatgcccaagcttacctggctgctcagagaatataaccagacagtcagcactgactactcacatgctcatgtttattaagagactctgactggtgggaatggagtcatcagagccaaaagcacgtgtgcaaaagaaaatgagcgttttcaccttttaagcgaagattgtttgggggttgagagaatgctggagcctgcgctaactccctgggccagcacaactgcgacgtgtcctctgcaggggtctccagcctggtgctcccagcgagataaaccagggattacgtctagagggtcagagcatctgcacctgtctagacagaggctctaaactggggcagtggggtgaggttggaaagcagcagatgggatagatacacggagttggagggagtcttctatttaggggtatctcagcagacattctcagctgccaaacagccagccccaggcatttccctgttgcagaggtgggtgcccgtgctatccaatgattccctcggctgacagacagggatggggtgaagaaatagcaggagaagatgagaaggaaagggtgagtgaaacagaggaggtgggggaggaaagaaaatgtaaatgacacacaaaatgctctgagatgcttactggatgccagacactgtcctgaatgtttcgcgggcactgagtcctcctgacaagcccatgagggagagcttttatttcctccattttccagaggtggaggctgaggcagggaggtgggttatggcctttctgcgagcattcgcaaacattcaccgaaacacagtatgttcaccaacatagagttcaaaagccacactgagaatctgcgtggtccatcaataacgtgttgggcatgttctatgatctgaaatccactaggaccctgggctaccaggcccaatgtctctctggagtgtctacagcctagccaggggaaagagagatgctaactataacaatgacatgggataatgttgttgtccaggtgcagacactcaagtattgggaggaaacaaaaggactggaaattgagcccaggcgtttgagaccagcttgggcaacattagtgagaccccccccaacccaccgctctctacaaaaattaaaaaattagctgagcgtggtgctgcatgcctgtagtcccagctacttgggaggccgaggtgagcagaccgcttgagcccaggagtttaagaccagcctgggcaacatggcgaaaccttgtctctacaaaaaatacaaaacattagccaggcatggtagtgcatgcctgtagtcctagtgactcaggaggctgaggtgggatgatcgcctgagcctaggagaacaaggctgcagtgagccgtgattgcaccactgcactccagcctggacgacagagtgagaccctgtctcaaaaacgaacaaccaccaaagaactggaagagtcctgcaggcacttgggattgctcagcaagcacccgggagagcttcacaggggtctggaatagtccagcaggtgcatgaaagaaccccggctatatctgtaccttggaagagtcaagtgcaggagctaaatttccatgggaagaggtgagggacatggagttagattggaaaggtctctgaatggcaataaggagaatgatatcctgtgacccaacatggctgctatccgaagatttccaaagtggaaatgtgttaggactttttccgttgcaaaagatagaaatcaaattcaaacaactagactgaaaagggaatgtgttaggactctggggagctctaagaaccgtagtgactgcagggacatcaggaagaataacgtggcttgcgaatggagccgagacaccctgtggctccccctttgatctaggtttctctgtgcctggtgtcattcctcccctgcaggtgggcattctccatgtggcaggcaacctctgtgtggcagaaaaattctacagggcagggtaccgggaggcaggtacttccatagggcaggctgccatgagccagcacctccagatagcagtacttctctgacatcattgcaggttagagatccctgaaaaacaatttctcagccttgattttaaaaaccccaaggaaggagggattctgattggtctagtttcagtcacgtgtcaacagcagaccaatcaactgtggccaggggcacagatgctttacagaggcaggcctgtgtcgtgtgaccaccacatgacctgcgtcatgtgatgggtggaggagagggtgggcatgctgtgattggcagcctccttcccgtgggtggagaccttttataaagggaagggaagagcgccatgtggataaacagatgttcaccgcaggaagggcccgaatcagatgggttttagagattactgggaaggcagccccagggatggtgggtctgaagctccgtgatcagccgcagaaatatttctcaactttgctcaacacaagcgcacttaccccacccctagataagaaaaacaagccaagcctttttagaatgttatctgaaattcaaaatagattaagtctcaggaagataaataaaccaaatgagcactgcttggcttctaaaccacacgcccatcccctggggaggcaggcagcccacactcctgccagaagagaaaagaccagctcttgaatggaatgaacagttgcattggtgggaggggaacaggcactggagttgattctccacgtgcttctcgctgtcatgggcccaggactgccgggcatctggtaaacatgcagattctgatgcagaagggccaaggctgggcctgagggtctgcttttccaacaagcttccaggtcgcggggtggggggggggggttgctgctggccctggcaccccactttgaaggagtgaagacttacggcctagcacctgcagatttgaatgagatattggcgaagagctgcgagctagccctcaaggaagccacccaggtggccagcgctggtggttccatctcagatggagctgggcatgactgggccaggcagatgtgtgggccttggccaagcctgggccggcccctgctctgggctgctcacacccatccctggccacacggaaaacttgtgtcagagccagcagggaaaggagtgaacttgctctcacttcacacttggatcagagcccgaggacctcagtggcggcccccttggggtacctgtgggggctgaaagagacagagcaggcttcctccaggccccccgggcagctttacccggcaacaagaatgggtgtcctaagccaacccctctctgtaggtagaataatggcctccaaacataacaggttttaatctctggaaactgtaattgttactttacgcggcaaacactttgcaggtgtgattaaattaaggcacttgagatgaggggattattctggtgaagagggacgcagggggacatttgacacagaagaggggaagcgatatcaccatggaggcagaggttacaggggtgctgccctgagtcgtggaagctggaagaggaaggaacagattcttcccagagcctccgatgggagggcggccgtccagcaccttgatgtcactgcctctggcttctaggactgtgtggaatagacttctgctgtgttcagcctccctgtgtgtggcagtttgttcccgcagccacgggaagtgcatgcaccacccccccgccgggtgctggggagacgtggaggtcttggggggcgtcccagggggctctgcttctctgctgtctcttcagaggagggcttctcttcgggctgttgggaaggggctttggggtgtctgcatctgttgaaatgggggctccgcgtggggcagcagagccccaaggtcgggagggtgttcaaggctgagcgcagcagctgcacaggaaagaacgcaggaggttgagcctgcgcctcccggagggagggccaaggaggagcagggaggtctgtgcccaaggatccgccaagccgcagcaggctgtccccactcactcctctctaaccaccctcatgccctggcctaggacctgacctcctccatggctgtggcccagcccactgctgccccagtgattcccgcatagtcagctgcgggcaggactaggggcctccctcccctccagggtcttccctgggacaccagcctgctccttgcagagtgaatgaaaggccttgttaactcaggccttctgcatcctaccgccaggagcgtgctcagtgcgcactggggagagacgaggggaagggaaaaaagcacaataggccgggcgaggtagctcatgccggtaatcccagcattttgggaggctgaggcgggcggatcccttgaggttgggagttcgagaccagcctggccaacatggtgaaaccccgtctctactaaaaatacaaaaattagctgggcgtggtggtgggcacctgtaatcccagctactcaggaggctgaggcaggagaatcgcttgaaccagggaggcggaggttgcagtgagctgagatggtgccactgcactccagcctgggcaacaagagcaagactctatctcaaacaaacaaacaaacaaaaaaaccaaagaaacaaacaaaaaacccaaaaaaaacacaacaaaaaagcacagtaattatattttaaaatcttctgggatacaacagattagatttccaagaaagggtttgtttgaatgactcattgtgcagataaaaatagttcttcagggtggggtgtggtggctcaagcctgtaatctcagcactttggaagggctacgtgggtggatcaccagaggtcaggagttcaagaccagcctggccaacatggtgaaaccccgtctctactaaaaacacaaaaattagctgggtgtggtggcgggcacttgtagtcccagctacttgggaggctgaggcaggataatcacttgaacccgggaagcagaggttacagttagcccagatcacaccattgcactccagcctgggcagcagagtgagactctgtctcaaaaaacaaaacaaaacaaaacaaaacaaaaaccctcaggtggagtgaatgagcctaattaatattccagaaacaattttgacaaaggtggcattacagattgaactttgtgtctccccagaaaaatacgttgaggtcccaacccccagtatctcaggcagtggccttatttggaaacaggtgttgcagatgtaaatagttaagatgaggtcctaccagacgacagtgggcccctaatccatgatgactgctgtccttacaggaagacagccaggtgacgatagagacacaggaagaatgccgcataacagcaacagaaacggagattagggggatgcagctggaagcccagggatgatgaggattgccagcaacccacagaggcgaggatgaggcaaggaggaatttgccctacaggtttcagaggggacaagccctatgcacaccttgatcttgaacttctggtctccagaactgtgagacagtaagtttccattgtttaagccccgatctgtcatactttgttagtgcagcccaagcaaactgataggggcgatgtctgccccttctttgctctgccctctgccacctgccatggcagccccccatggccccttctcaggtggtgacccccttctccttggtggcaccctcaataatcccctatcctgtgtctgaaaatgggcaatcacctttattaaagaaatgaggcttttctcactccccggccatcttagcggctgctcttggttggggtccgtcctgcagctaaggcgggaatttggtggctgcaaagaagaagaaaaagctcctggagtcgatcaactgtaggttccaactcattatgaaaagtggaaagtatgagctggggtacaagcagactctgaagatgattagacaaggcaaagcaaaattgatcattctcactaacaaccacccagctatggaatgttggccaaaactggtgtccatcactacggtggcaataatattgaactgggcacagcatgcggaaaatattacagagtgggcacaccggctatcattgatctaggtgattctgacatcattagaagcatgccagaacagattggtgaaaagcaaaccatgcaaaattttcctttaataaaatttgcctgagcttgttaagaaaaagaaagagagagagacagagagagagagaaagaaagaagaaagaaagaaagaaaagaaggaaagaaagaaagaaagacgagggagggaggggaaggaaggaaggaggtgggagttggatgcaaggaatgcgaccctcagggacccgcttcgaacagcccatcagacccacttttgcccttcaaaggaggttgagaagctccactctgttgtccatgcagctattcctgctcaagctgcagctgggacttttataagaaactgccttttagagccgggtgacatcccacatgaagaaaccagggccggtgcagtggcccatgcctgtaatcccagcactttgggaggccgaggtgggaggatcacttgaatctaggagtttgagaccagcctgggcggcatagtgagacctcgtctctacaaaaaataaataataaaaaaattagctgggcatggtggcacatgcctatagtcccagttacttgggaaactgaggtgggaggatggcttgagcctgggacgtggaggctgcagtgagccatgatcatgccactgcactccaggggggtgacagagcgagaccactgtctcaaaataaataaacaaggagtgccacttattgtcacatttggatttgtttctaacatcgtgctgagtttggtcacccacctcaatcacctgatgtgacttgaaaccacttctggctatttccaaaaatcagctccgcactgggaggggttagggctgccctttaaggaaacattaaaagctcagtatcttcctttggtggctccttcaggggcgctagcttctgactcatcagcatcattttagctctctgagggttcagaaatagaggaaacagcacttccttttggtgaacgcctttgtattattttattttttcaccatgatactgaaactagctcatcctgggagagtcaaaggaagctcatatgttttccctgagctgggctaaattcctgattcttctaataggaaagatccaaaacttcccacggagtttcccctcgtctgcactgagtcacatacctgtgggcttcgagctaacagaccttttttaatcaaagagaagatgaaaaaggcaccttgcttctgtcccatttttagatcttttttagccccatttcttctctttccttcctccatttttgggtttgtttggtttcacgcctgaattaaatgttaacaggaggagcaagttttatacattgcctgaagtcatcattgtcagagaaacaaatgcaatctttagtgaggctagcaatggtgggaagaagacgcgtgggttacagcaagcacagttactaaagctttttgcattgagtagctgtggggtccagggctccatctctctggccctcacttgctcatgagcaaatagaggcttcaggttgtagcaggttgtctcaaactagggacgtatattcaacaaacctgcaccttattcaaatgtagattctgatccttaggttctgggtggggcctgagatcctgcacctctaacaagctcccagatgacaagcatccaagatcacacttttcctagctctggatcacacttttcctagctcctagcagaatctcaggctcatcccagcctcttgagccagaattcaaattttcacaagagccccgattcgttcagatgtgcattaaagtgtgagaagcccacactggatcactgagggaggtcgcagttgcacctggggaaccaggaaccgtggaggcatgagcccatcctggagaccctgatttagttggtggggagtggcctggacatcgattgctgcctattcacagtggttcttgattttgctgccattaacatcacctggggagctctgaaaggcgtccccgtgatgttaataggcagcaagatcgggaactactaggctgcgggttcctcaggttctaatctatgatgtcattggctttatcagggcaatttttcctggccacattaggcaggagaggtgcctgtgcatctcagaagtgtctatggaactctgcttctgaacttcccagcacgctcaaaacaggacctggtttacagcaaagggccagctcctggcaacatcatgaaacaaacgtacactatcctctacccagggttcccttcagcctataggtgcccgacggcccctgctctgtgctccatcctgacatcaggaaacccacgaatgggagaaaatctcatgtcacctgtttacaggtgagtgaacatttaagtcaatgggttgctctctcctggggagctctaattgtagaatttaagagggcagagtgaagccagtgggagtcctgccaggtttgagtcacagcttggccacttatgagtccctctcattaccccaccagagcccggcgtcctgatgcataacacccaccacccggcttagggagggctgacagagtgaattactgacagaggatggcccttggccatttctgcttccttcactttcccatcactgccttagaatctggagagactcatgctggcttcacctggacaggcatcctgacacgcaagcgaggattgctcccaccaattttctgcgagagaaacaggggttcggttgattcctggcaacacgttcgtgtggggatgcacgtgggggtgcagagctggacttgggagatgcttcagctgatagcacacttttcctttggggagttttcttcctgctgttataacacctgtctccaaacaaagccttcattggtcaacagtgaatgattcatttattctgtgcatagacctatggcgtgagatgcatttggaaaccttgagaacagcggttcccaaccttggtgcttggagtaatgtccgaggacatttttggttgtcacaactggggcagggaactgttgctggcgtctagtgggtggggtccaggggtactgctaaacgtcctgcagggcagaggctagtgccaccgcagagaatgatccagtgcaaatgtcgctggtgctgagaatcctacttcagacccagggcaagactgattgcatgtgttcatttatatctgctcttgtagtcattcagtcaagaaatgagcaccttgaatgactattaaatcaagacaggttgggtgtggtggctcacacctgcaatcccagcactttgggaggccgaggcaggtggatcacttgaggttaggagtttgagaccaccctggccaacatggcgaaaccctgtctctactaaaaatacaaaaattagcagggcatggtggtgcatgcttgtgatcccagctaattggaaggctggcgcacgataatcacttgaacctgggaggaagaggttgcaatgagcagagattgcaccgctgtactccagggtgacagagcaagactgtctaaaaaaaatcaagacagatctctgagactccacaggtcaatggaagatgaacagaggggcggtggggctgccccccacccatgtgggaggcatgggcaatgcctaggttgaccagctgcccatgctctgaggcagtagtctcagggcagggtgtgcaccctcccaggcagggcagcactcacttatggtacagaaggaatcttagagcttcccttactcaggaatgaaatgagctctagcccctgccatcaccttttgctcaacactcacccactccaggcttcaaaaggaggctgcccacatggacagctcagagggactccagggcacgtggttgatggagaagccagatgcagagtggttcacttgggggtgcagttcaggaagccacggggtgggtgtgagggtgtagtggagcgtatcagtgcaaggataccctgagactgggggtgacattgactccacaggcacgggaaggagcttggaaacagactgaactcagaacatgcatgtcacgaggggaggggctggaggcttggggttgggagaggctgcctccactgctgagggcacaacttcctggttcagccccggcaggcctgcagatccccctgcatcctttccctgaagatgggccatctgtgcctagacaggttggcatgtgtattagattcttagggctgccacagcaaagaaccacagactggggggcttaaataacacaagtgtattttctcacagtctaggaggctggaattgcaaggagctcagggtgtcagcagggctggtttctcctgaggcccctctccttggcttgcaggtggccgccttcccatggtgtcctcacatggcctctcctctgatgtgccttcctcttcttagaaggataccagtcctattggattagggtctgccctaaataactcattaggacataattacctctttaaagatcttaactccaaatatagttttattccggggttctgggggttagagcttcaacatgttgattttgggggacacacttcatcccataacagtgtgggctgccattctccactggccctctatcctggagacacacctcctagagagtttcctacaacatgcaggacatctagttaaatttgattaaattgtatttcaaatgctgcatgggatacacttacccaaaaaattatcattgatctgaaatttacatttaacccagcattctatatttctagctgctgagtctggcacctctacccactgggaaacctcctactcatggctccttacctgggctgccttggtctgggacggacacagaaaggtggagggtggaattggtgtctggaggagcagctggtatctgggaatccatcaagggccctggcctcatggctctttcaggacaacctatagaagccactgagatgctggggtggcctgtggtttgatagaaaccgcagcatctatttaggtgaatcctggaggtacttcctgtttctcttccagttttcacatctctgtagaatgggaaatgtcacacaataacgaaccactaacaaatgatccaatttccagttgcagaaaacacatgacgtcatgcacatcatggtgttgaaaatatgggtgcccaatcccttacccacaattctgaaatccaaaacactctgggaacattttttatgtgtaaatttgaagacaaaacccatttggggataaaattgatttgaatggacttgggactatttatagactttctttatccattggtgagaatagtgatactgtgttttctggggggcactgtccagacatgtggggggttgtaggagattggtcagggtggtgggaaaaattgtagaaagaatgcaaaccttcctggaaggccaggaggttttacaaaagctttggaaaaggatttgggctgaaggcagccagattctcttatctggtacctgaaagcttaggttagataacaaggggatgtaaagaaactgatctagataagttagtttacttaggcctcggaacctggcctttaatcgcctgtgtgcaggactgctctctctgggggagtgaccatgtaaattacccacaagtgtgttgactcaaggcctttgtcattaaatctgtactaaataaatgcccgcagtgccagcttgtcagggccgtggctgctgactctttacagcaccctcctcagtgtctgtgagcggcctggtcccctagcccactctttcactggatacctgtgtctgagtgcatgtgttcatctgttgttcggccaggatctgcaggccagacccagcagtgggtagtaagtgatattcaggatatgtcctgtattaccagcctacagctccccaaactcgaatgccaaaaacccacagctttctggataaatgattgtgcagctacaacagcagacaggcaccgagctcttaaactgtgggaggcacaatgctaaatgctttaggtttcttatctctttaatcctcataatctgcaaaatggatacttttatttgcatttttggtaagctgtttttgtgttgaagtatgacatgcccacagaaaagcccacgaatcaggtgcccagctggaagaattattagaaagtgagtccacacccatgacaccacccagcgccatctctcagcagcgccccagaggctcccaccacagcctgccgccatcattacctcccagattctcactttcatcaccaaagattcattctgcctagaaaaaaaaaatgctgtcatttattgagcagttattatgtgccaggaacttatattatttctcacattgactctatcagggtgagtattctattttttttttttttttgagatggagttttgtttttgtcacccaggctggagtacactggcgtgatctcggctcactgcaacttccgcctcccgggttcaagcgattctcctgcctcagcctcccgagtagctgggactacaggcacatgacaccacacctgatgaatttttttttttttttgagacagagtctcactcttcactctgtcacccaggctgcagtgcagtggtgcgatcttggctcactgcaacctctgcctcctgggttcaagtgattttcctgcctcagcctcccaagtagctgggactacaggctcgtgccatcatgcccagctaatgttttgtatttttttttttttttttagtagagacagggtttcaccacattggctaggctggtctcaaactcctgacctcaggtggtccacccgcctcagtctcccaaagtgctgagattacaggtgtgagccaccatgcccggccagggtgagtattcttattatttcattttacaagcaaaaagaagccagagctgagagctgttatgtcatgttctattctatatcatattatgcatcttatcatgttatgtatcataacctcagctcagggaattttcgcagacagaacacactctgctaactagcacccagatcaaggaacagaatattagaagcagcagagaaactgccccctcaatcccacagccccccaagtcgctatcccctcccaaaggtaagcactattctgactcctgacaccttttgcctgtttttgaactgcctgtcaatggaacgaaatggtctattctttttggtgcctgattttctctcagcatgatgttcattaagcccatccacattgccacgtgaggctggagtttgctcttttttagtgctgagtagaattccaccattatttaagcacacctctatttattcacccattttccccttgcaggatggaggttagaaatgttttcactttttagcaatcaccagcagtgctgctctctaaattcttgcatgtcttttggcggacaaacacacacgtttctgtttagcatatgtgttggggcggattggggggcatcacaatagtgtgtgtgtgtgtctgtttagcttttcaaaaacttccaagctggccaggcatggtggctcacccctgtaatcccaacactttgggaggccgaggcaggcagatcacttgaggccgggactttaagacgagcctggacaacatggtgaaactccatctctaacaaaaatacaaaaaaaaaatccgccaggtatggtggtgcatgcctctaatcccagctactcaggaggctgaggaatgagaatcacttgaacctgggaggaggaggttgcagttagtggagatcatgccactgcactctagcctgggtggcagagcgagactccatctcaaaacaaacaaacaaacaaacaggccatgtgaagatgaaagcaaagatcagggtgctgcctctacaaaccaaggaaccccaggttttccctgccaacaccagaagttagaggagaggcctggcagatttgctctcacagcctcagtaggaaccaaccctgcggacaccttgctcttggactaacagcctgcagagctccgaggtgaggcacttctgtggtttaagcccctctgctcatgacactttgttactgcagctccagcatactcctccacggagtgatgcttcatgtttaaaaagacatctgctctgtaaagaacactcatctggccgggcgcagtggctcacacctgtaatcccagcactttgggaggctgagacaggcggattacctgaggtcagaagtttgagactagcctggccaacatggtgaaaccccatctctactaaaaataaaattaaaaaattagcagggcatagtggcaggcacctgtaatcccagctactcgggaggctgaggcgtgagaatcacttgaacccaggaggtgaggttgcagtgagctgagattgcaccactgcactccagcctgggagacagagtgagactctgtctcaaaacaaaacaaaacaaaacaaaacaaaacaaaacaaaacaaaacactcatcctagtgttccttgaggtggtctgattagcagctaatgggtttacaacagctttcccttttcaaatttgatttcagaagccatcagctgcatgatttgttgtatgtctgaatgcttgaagtgaaggttgatagttgataggagctggctgattctggtctataagtgtggctgggctgacaaacaggcatccacctacttgggctgggtcccgggagcagcctcaggaattgagattcctgcatctgccttcatggtctttatcttccaggcctccctctccctgtcatggctcaggcggggaccacggcagagggtgggccacaccatctttcaagggcagctgggccccttctggcagctggacgaaccttattcggtgcagtggctcatgcttgtaatcccagcactttgggaggccaaagtgggtggatcacttgaggtcaggagttcaagaccagcctggccaacatggtaaaaccccatctctactaaaaatacaaaaattagccaggcatggtggtgcatgcctgtggttccagccactcgggaggctgaggcacgagaatcgtttgaacccgggaggcggaggttgcagtgagccgtgatccatcactgtactcccacctgggtgacagagccagattccgtctcaaaaataaagaatgctgttcttcctgggcagagagtttctctgttctggaggtcatccagtagcccggccccaaggtgatctctctggatgggtgaggggaggaggggtctcctccagctggaagcatcgaatcaggactagcacttcctaagagcacgtggcccagaactgggctaaaaatagtacaatttttaaaaattacactaagctttgatttcagagtgtattggtttcctggggctgctgtaaccaagtgccacaaactgggtggcttaagacaacacacatttattctctcacagttctgaaggccagaaatcccgaagcaaggtgctggctgggccatcctctctcccaaggctccccggaagaagctgctcttgcgtcccctcattctgatagtcacagcgcccctggtgtctttagtttggagctccaatgtctgcctctgttttcacgtggccttttccccatgtgtctgtgtctctgtgtccaaatttctctctttttttaggacaccaatcactagataagggccgaccctcctccagcatgacttcatctaaatttgactgcattcacaaagaccctatttccacgtaagggctcactctgggattccggtggacatacattttggaaagacactgttcaacccaatatagagtctttcctgttttgaagtaagtttttgctaaattcaattttagaatgccttcctccacttccttgagcttggatagtttagaaatttgaaaatttgcctgttagggtaatctccgtatcttaacataatgtaagtttattttggtcacgtgaagttcaaaatgagtgatcttgaggggcagttggtgtccatctaagcagtgatttgggggcctgagctccttctatgtgggatgccccaatcttccatgtgggaaccctccaaacttccatgtgggtcccaaggtccctatgctcccctgtctcaagctgaaggggaagagcatggcgtgtggggagccaggccaggaagtactgctcatcctgtccatgcgtattcactgggccagaattcagctacaggccacagtgaagccaggaggggtaggctggccgtgcacccaggaagcagaggaaggggttggggaagagccgcagctgaggctggcgagtcaggatggcgcctggagggcagctcctcctaggactcatttccctttgctttccccccttcttccgcctctccaccttgctagccctggcgggtctctagtcaagagggtcagtttccaaacctcatggcacgagacccttccccactgacatgcaaacagcaaaggagcacctcccatttaaggggagactgaatgatcaaatgctaaaggaatacatctttgggggtgctgtgaacgccctcagtgaatctgggtgatccagcctggtggattgtgggggccctgaaggtgcgcttctcactaaacctccctctatgcccactaggagcccactgcatctcagagcaggggatggaacagttcccctggggcggggctggtgcttaggaagctgggcccaggtatcctggacggagtgcttggagtcttgtctgaacaggatcctcaggctgtgccacacagtcccagggcagattacacttgacacctgccccctcactggccacttcaccttgccagtggttttcaaactgccaggcaaggccagttgaaaccagtgcttaaaaataaaacagggcagggtacagtggctcatgcctgtaatcacaagaatttgggaggatcccttaagctcaggagttggagaccagctggcaacatagtgagactttgtctctactaagagaaaaaaaattagctgggcgtggcagtgggtgcctggagtcccagctacttgggaggctgaggtgggaggattgctagcccaggaggttgaggctgcagtgagccgagattgcaccactgcatccaaactgggtaatagactgagaccctgtctgaaaacacacacacacacacacacacacacacacacacacacacacaaaacctactagaaaaataccaggtacatagaacacagtgagagaaagtactgtgtcattaaatcttgattccatgtttatatgtatattttctgggttgtgatataaaacatttctttccaagtgaggcaatcaaaaactgaaagctggccaggcacagtggctcacccctctaatctcagcactttgggagaccaagatgggaggactgcttggggccaggggttccaaaccattctggacaacatagtgagaccctcattctataaaaaattagtttaaaaaattaatttaaaaaattagccaagtgtggtggcatgcacctacagtcccagctacttgggaggctgaggtgggaggatcacctgagcccaggaggttgaggctgcagtgagctatgatcatgctactgcaccccagcctgggcaacagagtgagaaagatcctgtctcaaaaaaacaaaccaaaccaaagaaatttgaaagccactgtcctatgtggaagaatttggaagtcaatgataacacagggaggtagtaattattttccaggtttcagaagtgcttgtgggtcccgataggagagatgctgtgatggtgtgaggtcaaggaggactctgggctgggttgaatcggggctgtaccacttccctcaggaggtccttgtgagggcgactccattgcctgggcctccacttttcatctgtaaaatgggctaaatatctaccttgatggggaggaggaggatgaaatagctcctcactcttgaatgctccctgtcctaggatttgttctgagtcttttatgtatattacatcagtctttcttcacaatatccctctggttaagtgctagtaccattagtttatcagtacaggtaaggacactaagacacggagaggtgaagtcacctgcccaagtgagctgatgtcaatgaaaatctgtatcatgccaaatactgtgtctggcacatagcaagcacagagcaaattttaattttcttacccttaattttgtttcaatcgctttaaaggatcctcagatataggcagacaaacaagctggtggaagatgtgtgagaagcacacttcaaactgccaggaagctggcttctatggagtcccaaagtgtgaaattagctcctcttctgtgagggtccctggaaacagtggctgctccctgcaggaggcagagtccctgcaagccctactcttcagcatcagaggaactgcaagggaagtcaaagaaaggggaccctcccctccagcccttaggggaagactcatcgatggtttcagggaggaaagagaatgatgggcctggctcacagtacactaccttcttgctggattttaaagattagaggcccaggaacccccagccctactccacaccctgcaatacagatcagcttcaaggggtctccacctcccctgcccacgatggccggccccactcctccagtagagactgtgggccccactgtctggaggccaagggagaacagagctgcttctccctgggggagatcagacaagtaattagaccaaactgcaagaggcagctatgtcattgcttctcagaaatgataaacagcgcaaagagaggattgcatcacttcttcccagggtcgctgggacatttgctctcagagtccaagctgggtcgcattttaatcagaggggggctgtggactgattccctgccgagtgcagaaatgtttcatcagcaattagtatgagcactccaaaaggaagctacacgttctccttgccttgttcccacgtttgcttgttccaagtcgtgtctttatactatcttaactatataatgtcatttatgccatattttaaaatagttgtcttcttatagaacccatgactttgtttgacttcattaacaaaacttagtaatttaccttgcacagagcctgcccatatgggatatgaaattagtatttgcagaataaaaagatgttgatgacaataataatacacataatgacataataatattaaagtaaaagctaacttgcgggggccctctcttctgcctcctgtctgaagagggctgcctctgcagtgagcctggacgtgggactactgcacacatgaccctgcggacatcaggccgggagcaggtggaggcgggtggcggaggaagtggtagaggaggagaggccaggagctccctgagccagcgctcccacagaaggaagttcatcagaaaatcacagagggcctgggacccaaggtcccccatccctcaccccacccaccccatcagaggtttgttcccgagtacctgtgttttaaagtgcccagatggcctccagctgcccactctagcacttacaagtttggagtccagggtccccagaccgtggggtggcagtgaccacactggcctcctgaagtgggcaggtcagaggatcccaggcctggctgctcagagtgctgtctgccagctgggggtgacattcctgtcctggctgtgactgtcccctcagcttccgccttattcacccctgatgggaggcagaggtggagccaggagagctctgctcatgactgtgctccaggaggctccacctccgtgtgcacccagaaggcccacaggagagatgttgtagcctgcaaagcactactgcctgcacgactgcacggccggctccacaggctcctcggaaacgacagcaggagcaaagatgagggctacagtgccaggtgaacacctgggagccgtctgtgtccatctctgagttctattcgtttgctaaggctgacctaagaaagtgccacatactgggaggcttatagcacacaggtgattttctcactgtcctggagactggatgtccaaggtgtgcaggctggtttctccgaaggcctctctccctggctgcaggtggccgccttcctgctgcatccaccctcggcctttcctctgtgcaacagcgtgcctgcggtctcttcctcttcatataaggaccccagtcctagtggattatggcctaccctaatagcctcatttaacccccattccctccttaaaggtactgtctccaaatacagtcacattgggggttagggctccagcgtatgaatttggggggacaccattcagtacacagcaggaggaaaatcactttcacagtcacacagcacttccaagctgtgtgtgttgccttacgtgtccagcaccatgcgtgaagtattgtcgcagctgttttcgttaggatgtgtgggaagagcacatctgtcatcagttccagcccccagtgaccaagaacacgtccctttggctctgcctctggctcacactggactgggactagagctcacagctgcaggtgccaggcctgagggctgcaggcttgctgccaggcccagggcatgggctatccatcccatattccacccaggtgcagacagaccaacatgagtacccaggagagctgcaacccctgggcgccaccgagaccccctctcagcctggccccctccattctttcacttgagtaatgcaggttctctaggtgctatatacagtgctttgcaaactcagcttccagctttgtgcaaagagacccttgtgaagggggtccttagactacctttgggtttggcaactcgctagtaggactcacagcactaagaaaggctattagatttgtgcttacactttgaaaatacagatttaaattagcaaaggaaaaaggaacatagagcggagtccaggagaaactcgcacaagcttctggtgtccttgccctgcggggctgaacggatagcgtttattttccccagcaacgatgtttcacggcacacttgaggtgttagccaccatgaaagcttacctatgcactggtgttcagggttttcattggggtcagtcacataggcatgcagtgcccatgtgactgacctcggctacttggacctcagcccaacagaggtgaaattaatagagcatggcccagagcctcgggcacgtgtgaacaggctttcatcataaatcacactgttggcataaactaaggatgtggcccaaggcctcagatacacaaagccacccttatcaggagggacactccaaggactcaggggtcatctcttcggagctgatcaaggctgtatgcagggtttggtcaactcagatctgctgagtcacccttgacatcacagctgacatccctaagtctctttggctgggacatgtgggagctgctgctgtcagtgtcagaggctttcaatttgattcatgtttgacagtatgatttgggagaaattatatattttatcctaattttcatttatttcattatcagtgaagcagaacaactctctacgtgttttattgccatttgaatttcttgtgtactttgtctagtcatttgttcatacatatgttgagttatttacatttttataatttataggagcccttatgaattgtgcacataagctctttgtcatatgtggcaaatacgcttctactatttcttttaactttattcttttttgtgagtgatacagaaatgtatatttttgatgtagtcagctggtcaatcttttctgtcatgatttcagatcttagtgttaagatcacaaaggttttctgctccccaaactatatgctgtccaatatatcttctcatgctttatttttaaacacgtaaatatctgatcttttggaatattgtattataatatatttattatgttatgttatatgatatgatattatacatttcctagggctgttataacaaatcaccacaaactgagtgacttaaaacagcagaaatttattctttcatggttctgtttgcaaggaggcagcagggctgtgctttcttgaagggctctaggggagcatctatctgttccacggctttctcttcgctttgatgtcaccagcaatctttggcttatagaagaatcacttgagcctcggcccctctgtcttcacacggcatcctctttgtgtgtttgtgtctcttttcctcttcttataaagatgtcagtcatattggattagggccctcctaatgacctcatcttgattacaactgcagagaccctatttccaaaaaggccacatgcactgataccaggggttagaacttcaatgtatcttttgggaggacacaattcaatccataacatatatggtgtaacaaaacttcatttgtttttccaaatgcttacctaattgtcgtaatgtcatttattggacaatccatcctttatccatgggtttatttcaagactgattattctgctccagtaatgtattggtcagttctgctgaggtcacatactgtttgacaaagtattggtgtataaccacccaagataagcaattatggaaggaaattggagggaaaagttagctagcctcgcactgttagtatgatcagtctttcccagtcgtacagtctataatgggaggcctgtctgaaaatacttgcacttctcatttttatgcccttgtttggacttgggctgttcctgcaacagttggttatgtctgataaaaaaaaaaaaaaaagaggaactggccaggtgcggtggctcacgcatgtaattacaacactttgggaggctgaggctggcagatcacttgaggccaagaatttgagaccagcctggccaacatggtgaaaccccgtttctactaaaaatgcaaaaacaaacaaacaaacaaggaaacaaaaaattagcctggtgtggtgatgcgtgcctatattcccacctatttgggagactgagtctatgagaatcacctgagcctgggaggtggcggctgcagtgagatgagattgcgccactgcactccagcctgggtgacaaagcaagtctctgtctcaaaaaaaaaaaaaaaaaaaaaaaagtaacttctttctttcatagccactacactgatatagggtttgaaatattaagagatactagttttaaacatctgcccagagtagtcctccaattcctggaacaatccagaagtgtacaaattctgacagagctattagaagccataccaatgctaagggtttaatggccaagagaaactcagtcactcctttaacatggatctattgagtgccaggcattgttctaggtgcaggagctacagcaaagcctgggacagacaaggctctctgtttcctttcagcttacatttcaatgggggaaagacaaggataagacaaacctaaagaggtacagaataccctctccagaagtaaagggaaagtatgtcaccttgaagtcctgggcagaatccgatccttttcacagctttatccatcttgttgaaatatagattattggcgacatccccaaaaagagagttgtagaagagaaacgcactggcagaatgacaggcaggtattagtgtggatgacaattgagtctaaagacattcttaacagcaatcttccattgatagcctactttattagttcatcagaattttcattcccatttgtgagacaggggaaactgaggatcagaaagattatctggtgatttgatttctgaaaagataatgcttatttagcaattcctccaggaagccatcagagtcctcatccatacaacagatgcgcagtaagtgatgaattttgctgtgaacacctgagttggaattagtcattgattgggctccactccatgagcaaatgaggtgagggggccagatacacacagataatatattttcttatttcttccattgcttgtccatgttcccatggattttttttttttttttttttttttacagagtctctgtcacccaggctggagtgcagtggcatgaccttggctcactgcaacctccacctcccagattcaagtgattctcctgcctcagcctcccaagtatctgggattacaggcacccgccatcacgcacggctgatttttgtattttaagtagagatggggtttcaccatgttggccaggctggtctcgaacttctgacctcaggtgatctgcctgcctcggcctcccaaagtgctgggattacaggcgtgagccaccacgcccagccttccatgaatatttttaacattttactttgatataattttagacttagagaaatttacaaaaatagtatagagagttcatatatatccattatctagctacctataatgttataaatgtatataactatggaacaatgctcaaatcatatatatccattatctagctacctataatgttataaatgtatataactatggaacaatgctcaaacccaggggaaaaactttgatacaagactattaactaagctacagacttatctgaattacactagttttctccctgtgaagtaaaggattaactcagcaggcttggggtgttcaaaccctgcatctcccagagaaaggactggcccttgactaccttctgggagacaaactctaagcccttgaaatatcctgcctgatgacagtctttgtttacttgggcccttgggccctgtcagatagtcggtaataacagcgtgatttatggtggggagtcttggatcttgctgtatccgtttgacctcttgaggaactgcagactgagtaactaaggtcagctatgaggtgttccatgcctctataactgatccctaataaaaaacctgagccccaggctttgagtgagcctccttggttggcaatactttctgtgtgttgtcacacatcactgctgggagaattaagtgctgtctgtacagtttctctgggtgaagacaaccagaaactggtgtttgtctctcctggattctgccctctgtgccctgttccatgctaactttaatctgtatcctttactgtaataaaccataactgtgagcatgacagctttttaaagttctgtgagtccttctggtgattcactgaacctgagtgtggtcgtggggacctttggcatgctacctaatatccttttctttctttcttttttttttttctgagaaagagtctcactctgtcacccacactggagtgcagtggaatgaccttggctcactgcaacctccatttcccaggttcaagcgattctcctgcctcagcctcctgagtagctgggactacaggcccgcaccaccatggccagctaatttttgtatttttagtagagacagggtttcaccatgttggccaggctggtctcaaactcctgacctcaggtgatccgcccacctcggcctcccaaagtgttgggattacaggcatgagccaccacgcccggccctaatatcctttttctattccaggatacaatccagcgtcctttattgttggtctccttcatctcctccaacctgtgacagttcctcagtgtctttgtctttcgtgaccttaacacttttggtgactactggtcattttgtagaatgaacctcaatttcagtttgtctgtttgctcatgattcattgagttcatgtaatttgggaaaaaatgctttatatcagataactgggatttttaaggagaataagctcttcagtacccctgtacacacacacacacacacacacacacacacacacacacacacacacacacacacacacacactctctctctctctctctctctctctctctctctctctctctctttccctatcagctggaattccccaccacactaaggctctcttgcaacactggctctccacctctactttcgctattcagttttattgtcaaacctcggatgaaagagaaccagtggcggccagtgttaaagagaagaactcagctttccctgttaacagaggcccttgtgcatctggtggtcatagcactcctcacattccttaattgaccctcaccccagatcgctggagcagggatgtggcggacattgactcttttgtctgctgagggtaatagtcaaccttcttctgggagatgttccttcttcccaccataaccacatggctctaaagagagctgccatgatctaacagactctccccacgtggccaccactgattggtcagagctgggcacctgaccctattggggccaattagagcccttccctgggatttctgggcttgagaggaagcagcacattcttcccctggagggtccttgcttgtggaagagccaggctagagtaggaggagttgaattcagacagaggcggagatgagcactggagagggagcctggctttgtcccaggtgtatctggaggcccaggtatgccctgcacccttcctccatgatgggagcctcactaatacatagaccacattccatcctgtctgcatacccgacacatggaaaaggctggacactccctacatctcatgattagccagtgaatgaaacgaaaagggccgagtgatacttcatcagcattgcagtttttctcacggtcctctctgtctttatgtttccatctatgggatgtagtaaatcagaaccaaacatgttgagcagcattcattttaacaggcgtcttcaagagactgtctacgtgattagcaaataccatctgcccgcctaatgaaatcagaacagccagtgttttccatcctcaactcagggattaaagaggaaaagccggtgtaagcaggtcacctgggttagcgtagctgtggagaggtgcgctgagcagattgcacagctcagccccgcccgagttaagaggagtcaggacacaaccccagatgccaaaggaaaagaaaggaagcaagacagaaaggagaaaaagagagagacagacagagagaaagagagaaagagaaagaaagaaagaaagaaagaaagaaagaaagagtctatattttacttcctgaacagctcattttataatacataaataattcaagacaaaataaattggttagaaaataataatgtttgtccactctatggctacggctatacgaggagcagaaataggaaacctgtgtatgttttgccaaaagagaatctgtttgctcatttaaactttttccttctgattataaaacatacacattcttttatggataactttcaaaataagggaaaatacaaagtgtgtggggcaggcatcactgagcgtagggagagggcgtggtcattctctgctcacgcccaccccggtgagggctgtgtctgggtgactggcagggttgggggtgcttctggaacccactgagggggcttttgggaaggggatgcaacggggaagagagcttggttctcaataatctatcagcttttggaacagcaacgttcgtttccttaggctgtgttagtttcctaaaactgtcctttaaaaagtaccccaaactgggtggcttaacatgacagaaatttattctttcacagttctggaggccggaagtccaaaatcaagacgctggcagggctgtgctctctgaagcctccagaaaagatttctcttggcttcttcctagcttctagtggttgccagcaagcattagcattccttggcttgcagctgcatctctcgaatcttctgtttctcgaaatcgctcgaatctctgcttctgtttccttgtggcgttcttccctgtgtgactatctctgggtatcttggatagtcatattggattaagggtccatcctgcacaactatgaccctgacctaacttaactaattacagctgagtgtggtgactcacacctgtaatcccagcactttgggaggccaaggagggcagatcacttgaggtcgggagtttgagagcagcctggggtctcaaactcccgactcctgaggtctttgcagtaactggtactcaagggaaatgctgaagaaaaaaggcggccgggcgcggtggctcacacctgtaatcccagcactatgggaggctgaggtgggtgggtcacttgaggtcaggagttcgagacatgcctggccaacatggtgaaaccccatctctactaaaaatacaaaaattagccaggcatggtggcatgtgcctataatcccaactactcaggaagctgaggcaggagaatcgcttgaacccaagaggtggagttttcagtgagcaaagatggcgccactgcactctagcctgggtgatagagcaagactctgtctcagtaataataatgataatttaactaattacatgcaccacgatcttcttttcaaataagttcatagtctgaagttccaggaaagacatgagttcttgggacacaatttcagtccatgcagcctctcttacccacacaaacctccctggcactgtggagtggagggcagcatggccccatcacggagaaagtctcctccgggtggtggggagtgttctgctgagaccctaccaggctctgcggaagccagggcagatccacagtggcagtggcctccgccggaacatttggccattgctgttctagaataccacaggaagttctggccttggctccagaggcaacaggcctcaggggcccaccctgtgagccccaaaaagcagtctaggtcctagggggtggttccagtgggccaccagaggcagtggcttcggtggggctgtgttctcgatcttttagaagccctcacagcactgtgcactcccttcacaataccgacaacaattccaaggaataaataaccatgaagttagttctttagtgtctgtctcagcaataggatgaccagctgtctgctaagtggggccaccaacttgtctagtttgtgctaggccagatttgcttcagcaccgaaagtaccacatcccagaaaccccctcaattcccagcaaaccaggacagctggtcaccctccttagcagacagatgggaatctcatgtgcagagccacggtgtctatctaatccactctatctcctgtgttcctgtttgtcaatggtaccttgcacagaacatgcatccaataaatatttgctgaacaacaatcataataatgattatctgcaatgctcagtaaatatttgccaaatgaatgccccctgccagtaaataaagaattctcttcagcattttaatatgttaccgataaatgacaccaactggatttacagactcatccaggaagcaaagagatttttgtccaagtagaaaatgccaagtagggtaagtttagcagcattcaatcctctaacaaaagatcagcaaatgtcctagagaggttgggtctgatttcctgaatccgtctttaagtggagattatggatttccagatcctctcagataggaggggccaaagcaggagggacaactgctggacagccgtagcggtgggaacgagagcttgcattgcacatcccaacacagcagtctcacaaaccttcccttggatgggatacactagactgtagacatggagggatggtgtgcttctctgtttttttgaaaatgagtctcactctgttgcccaggctggagtgcagtggcgcaatctcagctcactgcaacctccacctcccaggttcaagctagtctcttgcctcagcctcccaagttgctggaattacaggcatgtgccaccatgcctggctaacttttgtatttttagtagagatgggggtttcaccacgttggccaggttggtctcgaactcctggcctccagtgatctgcccgcctcagcctcccaaagtgttgggattacaggcgtgagcccctgtgcccagcctgatgtgctttccttgccttgcctttcctctttctttctttccctccctccctccctccctcccttctttcttttctttctttctttctttctttctttctttctttctttctttctttctttcttttctttctttttctctctctctctctttctctctctctctcttttgagacagtttcactcttgttgcccaggctggagtgcattgacatgatctctgctaactgcaacctccaccttccgggttcaagcaattctcctgtctcagcctcctgagtagctgggattataggcacccgccactacgcccagctaatttttggtatttttagtagagatggggtttcaccatgttggccaggctggtctcgaactcataacctcaggtgatctgcccacctcagcctcccaaagtgctgggattacaggcatgagtcaccacgtctggcctgatgtgcttttcttaaggatgcacgcaaagtagggctttgcaaccaggccatctgtgtgcttctttactgcgctgttctcccatttcacttaaccacagccacagcaatgaagcccagtggtcagtaccttcctgagcttgaatccaagctccaagtcgtctagatcaatctgtaactaagcagtggccacttagaccattgagatgtgaagaaagagccagcctggcaggtcttgcttgctcgttgcatgtctccagggcagcctagaacaatgacccttggccagccctggtgagtgcagtccccaggaaggttttgatgtctgtgattaatgattttgttctatacctctggaggaactggccacatgcaaccagcttgtcaggatagtttgcacaaacatcaaattgatgatgtgtacgtggtttcactgctggggtcctgagtttcacttggcatagctgatagctaagcagaatgtgtctatgtgatcaaccacccgaaaaaccttggaccctgagactggcatgggtttcctcgggtcttccacacatgtccttggagttctctgccagacaaaaaccacattctgagtggtctcagatgaggaggcatgaaggagcctgagctggactgttctggaatgcaaacaatgcgtatcttttcctgtggccttttctctgcatcctttgctggaataaatgttagccatgcatataacttgctattgagtcttgtcagtctttctggaaaatcaccaaacttagcacctcaacacatagaagaaaacagggatgctccgcccctgcttatcctgccggatgctgcccttgccccttccccccatcccccccaccccatccctgactccacccaggtttgaataagggctgtgggaaacaaggtttagaatggttaccgacaaaaccagagctggagttctaacccccgtggaggtgggtttcctctttggctcacagccccagtgtctacccagcaggaaaatgtggcaggaaagcatgaggcctagggcaacagggggcaggaggttgcggatgcctggggagcagatttcagggttgatagacttttggaatctctgggatttgtgaactctggttaatttctgtaaatggagccacaggtcttccccggatccctgatacttattactggctcagccaagcaaacactttgggttggagtatcctctagccctgcaagtctctgacctccacatgtgtgcaaatttctgttttacagtccagaagtacattgcaaattcattctctctctccttttatctgtctttatttattttatcttattattattttttttgagacagtctctctctgttacccaggctggagtgcagtgacgccatctcagctcactgcaacctctgcctcctgtgttcacgtgattctcctgcctcagcctcccacgtagttgggattacaggcacgagctaccacacccagctaatttttgtattttcagtagagacagggtttcaccattttggccaggctggtctcgaattcctgacttcaagtgatccgcccgcctcggcctcccagagtgctgggattacagtggtgagccactgtgcctggccctatctgtctttaatattctgtaggtataaactgatgagcacaaccatggacagaaatgtcaataaaatgattaaaatgtaagataactaaacataccaataaaacaattttattaggttggtgcaaaagtaattgtaggtttgctatttcaatggcaaaaactgcaattacttttgcaccaaactaataaaaagcaagccactcaaataattacttacacacttgctattcagataaagccctgacatttattttgcataaaaaataaatagcttataggccaggctcacacctgtaatcccaccattttgggaggctgaggcaggaggattgcttgaggccaggagcttgagaccaccctgggcaacatagcaagaccctgtctctacaaaaataaattaaaaaaaaaaaagatagtttatccagaatagccaaaacaattttgaaaaagaaaaacaaagtaagaagactcacacctcctgatcacaaaacatgctgcaaagcaatggtaatcaaagcagtgtggcattggcataggataaacatatagaccaatggaacaaaactgagagtccagaaataaatccatgtgtctatgggcaactgaatgccaagaccattcaatggggaaagaatgtttttttaacaaatggtgctgaaacaactggagagccacatgcaaaagaatgcattttagacccataacttacacctatacaaaaattaacttaaggaccaaagatttaatcataagagctaaacctctaaaacacttagaagaaaatatagggaaaaccatgacgttgggtttggcaatggcttctgagataaggcaccaaaaacacaagaaacacaagaaaaaaataggtagattggactttactacaatcaaaatcttttttttccatcaaacgataccatcaagaaaatgaaaagacaacccacagaatgagagaaaatattgggaaaccatgtatctgatgagggtctacatccagaatatgtaaagaactgttacaactcaacaacaataagaccaacaacccaattcaaaaatgggcaaagaggctgggtgcagtggttcacgcctgtaatcccagcactttgggaggccaaggcaggtggatcacttgaggtcaggagttcgagaccaccccggccaacatggcgaaacctcgtccctgctaaaaatacaaaattagccaggcatggcagcgcatgcctgtaatcccagctactcgggaggctgaggcaggagaatcgcttgaactcaggaggtggaagaggttgcggtgagccgagatcacgccattgcactccagcctgggcaacaagaacaaaactctgtctccaaaaaaaaaaaaaattattattattatttttttaaaagaatggctcttcttcctttagccaacaggacatgtccacttctgctttctctgtcctcccattcccaccccaacactggttgtcagtataagaaaggcaaaaaaaaaaaaaaaaaatagccaggcgcggtggctcacatcccagcactttgggaggctgtggatcacctgagcttgggagttcaagaccagcctgaccaacatggagaaaccccgtctctactaaaaatacaaaattatctgggcgtggtggcacatacctgtaatctcagctactcaggaggctggggcaggagaattgcttgaacccaggaggtggaggttgtgctgagccaagattgcaacattgcactccagcctgggcaacaagagcgaaactccatgaaaaaaaaaaaggaaggccaaaaaataatttatttttttatttttattttttgagacagagtcttgctcttttgcccaggttggagtgcagtgttgcagtcttggctcactttaacctctgcttcttgggttcaagcaatcctcctgcctcagcctcccaagtagctgggattacagacatgtgccactgtgcctgactaattattgtatttttagtagggacagggtttctccatgttggccagcctggtctggaactcctgacctcaaatgacccaccctcctcggcctcccaaagcgctgggattacaggtgtgagccactgcacctggccaaaaattgggttttacaataaaagaaattctggtccaatagagcaaagattcttagccagattcggatctcagatctcttgtgaatttgataaaagcagctgtcctccttagcttggaaaaatataaacacacacagagttgagtatgcaatctcagtgggttcatggatccctgtagcccatattccgactccaggttaagactctcacaggactgagcacatccagcatccacgctgtggcttctgaatgccattctccagtgaaaggaaccagagctcctcggagaaatggtcattccaggaagagaaagaacaacatgagcctggagcatcttgcagtgccagaaattaaggaaacgctgaaagaaataaaggagaactgttcaaagggcacaggggccagctgaggagctcccactgaccagatccaagacagttagagaatcagaatacataatgacagtgatgaatggcagcccatccaaatgcataagaatccgtgtgtccataatgatcatgaatgagtgaatgaagaaggggaagctcttcctcatagtggaaagccaactaatcatcacagaagaaagaataggcttagagaagccactgttttacaaccataattggtcaccgagtccagcaagaatccttaataaatgctaaagctcttggttgcgaggttggggaggaaggagacattgacctagtctcaaagtccctcccacagatgacctgttagttacaatggaaaagagaagattgtacagctggcagacaccaccttcaactcaagtcaacgttgtcactaagaggggactgaggccaggcgccgtggctcatgcctgtaatcccagcactttgggaggccgagatgggcagatcacctggggtcaggagtttgagaccagcctggccaacatggtgaaaccccgtctctaccaaatatacaaaaaaaaattagctgggtattgtggcgagtgcctgtaatcccagctacttgggagactgaggcaggagaattgcttgaacccaggaggtggaggttgcagtgagctgaggtcatgccattgcactccagcctgggtaacaagaacaagacttcatctcaaaaaaaaagctgggtcgggggtgtgggggactgaaccgaaccgacatcatgtgcctgtgatgggacgcacaaggaatggagacttcattgtttattcccagcaaactcaaatctagtaatgaggagacctcagatggccccatggggcagagaatctggggaagggcatcccagatcttccatacgattctcttcagtaacaacttctgcagctcctgcaaaaatatagtgtcgtgcaagacaaacaaagctaaaagacagtgtcagatgaagggagaccaaagagaattggccactaaacatgatgtatgatcctggtttggatcttggactggaagaaaaatgctatgaagacatcattgggtcacttggtaaccaggtaaccacattccagcaatgagaaatttcctggctcagataactgccctgtggttatgtgagaaaacactcttgtttgttggagatctatgtggaaatatttaggggtaaagggtatgatgtctgtaatctgctcctaaatggatcaggaagaaaaagagatgtgtatttataaaaagaaacagagatgatgtggccaaatgcggcaaaatgttgacaattagtatatccaggccaggcgccgtggctcgcacctgtaatctcagcactttaggaggctgaggcaggtggatcacctgagttcaggagtttgagaccaacctggccaacatggtgaaaccccgtctctactaaaaatacaaaaattaactgggcttggtgatacgtgcctgtaatcccagctactcaggaggctgaggcaggagaatcacttgaacccgggaggcagaggttgcagtgagccaaaactgggccattgcactccagcctgcgtgacaagagtgagactccatctcaaaaacaaacaaacagaaacaattagtatatctgggtgaagagtacatgggaagtttttatgtttcttgcaaatcttttgtaagttagccatagttaacataaaagttattggccggacgcagtgtctcatgcctgtaatcccagcactttaggaggccgaggtgggtggatcatgaggtcaggagttcgagagtagcttggccaacatggcaaaaccccatctctactaaaaatacagaaattagccgggcgtggtggtggttgcctgtaatcccagctactcaggaggttgaagcacgagaatctcttgaacccaggaggcagagatagagcagtgagccgagatcaagctactgcactccagcctgggtgacagagtgagaccccatctcaaaaaaggaaaaaaaagttatgttaaaaataaaaatcagtaaagtttttataatcaaaataaaatataataaaatttaaaaactctccaaaatctctgccataaaaactgtagagacaaaagtcagctcctttaggggtagtgcagcctgcagaagccaccacgtcggccaggtggtcggcaaatggcacagacgctcacttggctctgacaccagctggagtccctgaggctggagactgtcctggagagaagagcattgtttcctggcataagagaagtagaagaaaaccacttctgggatgaagtgagctctagtggaatccaagagcctagaggctccccatgggtccttagcgttagtggccagctgtgacccttccggtctgcagaccagctaaccacagggccaactgcactgattgagcccctattgtgtgcaggagcctgtgtgggctaggaggccccactggtggcttgcgtgtgtgtttgcatgtttgtgtgaacctcatttccctggggagccaagtgagaacgaccatcttgtcaaaatgccattgctagttgcgacaggtgagcgttgatggtacgacaggtgcaagaagctcttttatgccaaggaatattcaaaatatttcacttacattaagccattcaacagcctcctgcccagcagccccatggggtaagtatcactattgcctcccattttacagatgagaagtgaagtaaggcacctaaagtcaccaagatctgaggctcctggtcgacacaaaggtggcatgcccagcacaacaacacacacctcactctttggtcctgtcctcttggggtttttttgtttgtttgtttgtttgtttttgagacagagtctcactcttgtcgcccaggctgaagtagtggtgctatctctgctcactgcaacctctgcctccgggttcaagtgaatctcctgcctcagcctcccgagtagctgggattacaggcatgtgccaccacgccagctaatttttgtatttttagtagagacgtggtttctccatgttggccgggctggtcttgaactgacctcaggtgatccttccgcctttgtctcccaaagtgctgggattacaggcatgagccaccgtgcccggcctgtcctgtcctcttggaacagaagtcagctcgcctctaggaagcaggctccaagaaaacacaatcatggccgcacccttgcacagaagtcgtggctccctccctactggggcagtgggcatctcctggggtcaacgctcagttatgaatacattgcttaaacttgatcgttgtgagtttcacacccagttgggaaaaaagactggtttggtcagttggcatttcaggagtatctaaaatattgaagtgtatttaatatttcagtgtactagctcaagcttttgtgtgttttcataaaaaagttgctgccaaacatattttgaataccatttgtgaggacgtatggctctttccacgcctctcaaaggccagggaaagcagagttggaggaaacctcctttcctctccttctagagagtcatttaaaagtagtgagtactttgagaaaatgcttttgactcttggtccctttttttgagtattaaatcaattatagccacacagcaagcctgcatctccattcttcatccaggggccaccaaaaaaaaaataaagcagctgaacaaatataagattctgtaccatttccaccccctggcccccctgcccccccgccccccccacagcagaaatgctgcttgtttttggtcaatggtcaaatgataacctgaaagctcaagttcctttttttttttttttttttgagatggagtttggctcttgttgcccaggcttgagtgcaatggcgtgatctcggtgcaccacaacctctgcctcccgggttcaagtgattctcctacttcagactcccgagtagctgggattacaggcatgcaccaccacgcctggctaattttgtaattttagtagagttggggtttctccacgttagtcaggctggtctcgaactcccaacctcaggtgatccgcccccaaccacctgagcaattgcaagttgtaagagctttgggtcagaaatgcaggtgtcttctgatcacccaattgccgggaaagatgccacaacaacacaagagggaggccactatcagttccagcgtcatccccactagtaccactagggggtcaggccactctggccaccatggaatgctcgtatggtagccctaagtcatggttttccattcacagggacaatgtgaccaatgaagtaagcagtcaatacctttaggacatcaaggtgaaccataattgggacacagaagtttctggaagaggtaggcttgggcaaggcgggtgagcagcaggttgtgtttaccaaaaatggccatgatgctgccttctacactcgtgttcttctgcagtgtgactgtgtcattcccgcatgcagaagcagagtctctccatccctgggaacccagggctggcctgtggctcccttgtgactgataggatggagtagaatcgatgccgatgatgtcccaggctggcgtagtgctacaatccgaggccagggcagaacaggcctgatgctgaggcctggttcccttggaacgttcccttcaggaagttcctgctcagaactccgcctctgtgctgccagaagcccaaggtacaggaagcagccaggcactggggctcatacacaggcttggctgaacctggcttcccagggcaggggttaagagggaagaagcccctggaggatgtcagccatggccattcacagcttcctggctgaggcttcatcctctccaaactcctgacttgcagaatccctgggcatgggaaaatggttcttgtttgatgccatcaaatgtgggatgcttgttacgcagcatagataactatggtaaaccccgtgtcatgggcactgttgggtgatgcaggtctgggaatggggacatttggtgaggcaaggccctttggattctggttaggagagcgagttctagagctgcctaggttcaaatccagtctccaccacttaccagctctgtggcagtgggaaagtgacttaacctctctgtgccttgcacgtcttcctctgtgcaatggaggtgataacagtacacacctgggcaggctgtttgaggaccgagtgttgttagtgcccgaagagcaccaggctcacgggaaacgctcattccgtggtgtcacctctgatgggcacaggcctaggcctcgactggacggctggaagactgtgcaggtctagagggtgcttagacttggcaggcaattgtatttttttgtctcactaactaaactgggagaagacagttatctgtctgtctctcatcatctgtgcgttgagaatgtggggcatacagaaaatgctgtattttgactggaaggagttgcaagttcctgaaaaaagcctgctggtggaattgaggctgacatcaggcctgagaaggggaggggagggcattggggagtgagagggctgggcctgggcaaacgggttggtattgctttagtggggtgcacgcacatgtgtgtgtgtgtgtgcacatgtttgtgcctgtgtgtgtgtgtctgtatgtgtgtgtgaatagagagaggtggcccctagaaagggtgagagatgctcagtcaaaactcagatgtgagccagatttagacaatgaagggcccagtaggccacactcaagcaaggttgtggcagggatcatgatctgtattagtccattttcacactcctgtgaagaaatactcaagactgggtaatttataaagaaaaagagtttaatgcactcacagttccacatggtgggggaggcctcccaatcatggtggaaggtgaaggaggagcaaaggcacattttacatggtggcaggcaagagagcttgtgcggggaactacccttcataaaatcatcagatctcctgagacttattcactatctcgagaacagcaggggaaagacccgtccccatgatttgattacctcccactgggattatgggagtgataattcagatttgggtggggacacagagccaaatcatttcatgatccaagcccacattagccagggcagcgggcagcagggtgggagacgtgggaagggcacaaaaggaaacagagtcaagtcttcttccaggtgttctgcctgtgctgggggggccctctcacaccacctcctactcaacctgcagggctgggctggtgcatcaagagggaggtggaatctcattctccctgtgtgagtgcacatggaaatgtgatttcactcctggtttaacttttcccttgccctccagccctcagcttcactttttcgggtgaccaaataatgacaattttcacatcgccaggtttccttcagcatttgctgacggccgactgccttagacaccaaacacatgttatccagacgcctgaaacggccatgccctggggagctgtttagtagttttaaagaccttgaaaggccgggtgcggtggctcacgcctgtaatcccagcactttgggaggccgagacgggcggatcacgagatcaggagatcgagaccatcctggctaacacggtgaaaccccgtctctactaaaaatacaaaaattagccgggcatggtggcacgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaagaccttgaaaatactttgatgaaaatgcttctgatgacaagcacctattgtgctgcagatctgttgtgtgccatctgccttcattaaagacggggatgtgagggttttcccataaagaatccgaatcgccactgctctctggtttggccaaagaaagagatttatattatcatcacttttggctcccaaatggttaagcatccttgcgccttcgttggcacatagcgggtacttaataaacgtttgtgggatgagagtgaatgaatcactagatggaaggcactggcagttaggaggagctcattaaaacctttctaatggagatctcccagcctgcagcggctgtgatggtgaacaccagccatgcaaagcgtatgtctgcttagtaccctgagtctacaaaccggagggaagagagccgagagagcaagcaacaagtaatgactgctgcccctccacaatcccacctgctcggcccggcatctgctacccggccctccacaccatctgcgcccagggggctggccattgccaagcctccccacgtggcctttccagaagacagtaccatcactgacctcactgtcattggccccattcgccggcagctctggacaccagatgggcctggcgtggagcctcattgctggtggttaagcagtttagctcacttcttacctcagcatctttgaggacccagcctgcccaggagaatgctcacttctttctgttttcctttgggaattctatgaggctgcttcaggcactgattcatcctgtacatttttctcccatgggcatgcaggcctgagtgtgtggctcactttgtgcagatggccggggcctcctgctgcagaccaggagaacacggcaggcaccagattcttctcaaccttcagaatgcaaaggtcccagaaaggagtcaccttgagagccgagatgcaaacttctgtgtcactaacgtttgaactgctttcaaaccttgtggcaaattgttttgcatatattcccattaacaaataaacaaaacaaaacacacttcagtcttggagggttgatttgaattctagaaacagctgagtcattcacagccgagtctggggcacaaggtgggtgagccaatttggataaggtatttttaggtgaaaaatgaggaatgactttaaagcaatccaactgattttcataagtgactcttagcctgaatttggtgagtgtgacagacatcttgggcaaagggagttgtattgttctagaagtattatttcccaagatagcccatgaagacattcattcagatgggaaaactgagaactttttttttctgccacttcgagaaagaaaattagtgttcttttcttttttctttcaaccaatcatattcatttatacaagtacacaagtactgtataccagaatgatcaaggtaatgtcccccaaaaagacattagaccatcctgtaaagatgtccttgctttagaaaggaatcaatttgttggtatgtgctgaccatttcccactttcttttctgtcttcatgcaagtagcagaggcccctgagtggcagaggtacaggattgacccttgttcttctcacctggcaaagccaccgtgccaggatgcattcactacctccctcctgaccaaaggcatccatgacatgctgagtttctagggcagacccatggtcagtccatccaacatccaagcctcctctctgccttaccaagagaaccttcattcaaccctgcaaaactcatcctcctggcagccaagggctcactgaatggaggcagaagtcaactgacttctgcaaaatcttagctttcccaataaaagacagacatgctcacagcttcctcttctcccacttcttactttctcaaagatagacatgatgtctggagctacagcagtgcatttgaaaccaagaggaaaccagcctgagaatgaagagccaacctgacaaagacaaggaaaagcctgcatgcctgatggcattgtccagcaacggaagcaagaccagcaatttgtgactgctgggcttctcagcatatgggacacacgagaccctctgctcctagcagcagatacagatcaacctcacacacagggtattcctttgtttaacatggtaagtgctgtgtggcagtgtacctggggaccaaacgcacttccgaacctcagctgagtctattcatttagagaaagggtgggaagaaccacgaacttaaaggctgataattctcatcttgagagaattctggaatcaataggtctaacatgtttagtttctgacttaaaatgcactaaggcagcggggtgtgatggctcacgcctataatcccaggactttgggaggccgagatgggtgaatcacctgaggtcaggagtttgtgaccagcctggctaacgtggtgaaaccctgtctctactaaaaatacaaaaattagccaggcatggtggtgggcacctgtaatcccagctacttgggaggccgaggcaggagaattgcttgaacctgggaggcagagtttgcagtgagccgagatcacaccactgcactccagcctgggcgacatagagagactccgtctcaaaaaaaaaacacaacaaaacaaaaaatttgggtcgggcatggtagcgcatgcctgtaatcccagcactttgggaggccgaggcagggggatcacttgaggccaggagttcgagaccagcctggccaacatggcgaaaccctatctctactaaaaacacaaaacatttagctgggtgtggtggcaggtgcctgtaatcccagctgcttggcaggctgaggtgggagaattgcttaaacctaggaggcggagattgcagtgagccaagatcgtgtcactgcactccagcttgggcaacagagtgagactctgcctcaaaataataataataataataataataataataataataataataaataaataaataaaattttgaattgacaaatgactcatgctgaggaggccctaatcttctcataggcggcaggacaggggattgagtgcttgtttagatttctgttctggggaggggcaaaaggcatctggtttttagtctgtgcctgctgtgtccgagagactccacctacatcacctcatttaactcccacacccactttgacaaggaaactttattctctcttttatattttctgaacctaagtctcagagaggttgagtaatttgcccaaagtcacacagctggttgagcagatccgactccccagcattgatctctcccacagcagcaacccagccttgcacataatgagacttcagtcataatcgcttttcttttcttttttcttctttttgaagcagagtctccctctgtcagtcaggctggagtgcagggttgttaacatggctcaccacagtcttgacttcctgggctcaagccgtcctcccacctcccgcgtagctggaaccacaggcatgtaccaccatgtccggctaatttaaaacatttttttttttccttacaggcagggtctcactttgttgcccaggctggtcttgaactcctgggctcaaacaaccctcctgcctcagcctccagaagtgctgggattgcaggcgtgagccaccgcaccctccatcttcttgatggaaatctgtcagtgaagaacccgcaagtgactggtaatgctctattttctcagtcacaaactgagatgcacaggttttatttttcttttggtggggacaggagagtgggagccaaaatttgtcactgtaaagactcccaccctcctgtcctcaccaaaagaaaaagaaaactttgcatctgaggttgcgactgagcaaacagaacattaacttagggaaatttctccgtccgtgcattaactgaaggaaactgccgtgttgctctctgcactatttagagagaatgtgagttaggaactgttggaagagacatgaatagatatgaaatttttgtcatgacaaaactaatgctgtgttaataagaaacagatgaaggacccatctgtttcattcctttctcttcttaagaggatatagccgaattatggttaagtaaccctgaggacagttacatgatagcctttctcatgtcaaatgtgtggaaagagagtgtgaggtcgaagtttcaggtattgtaaataaatatcttgtgacctgaacaactttttaattagctttatttctaccaaaaaaaaaaaaaaaaaaaaatccagaatgctgtactgcagccaagtgaatgaatacatgtaaggtgtctgtgtcagggctgagaatgacagggccgggcaagtccaaacctgcctcttctcatgccatcgtctcacatggcgcccctgaggaagtagcaggaacaggagaggggactggattgccccctatgggctgaattgtgtccccccccaaaattcatctgctgaagtcctaagccccagtacctcagtatgtgactttatttggaaataagattgttgcagatgtaatttgtcaagatgaagtcatgctggaataaggtggatcccataatccaatatgagtgggtttttaaaatttttaatttaatttaatttaattctattttaagttctgggatgcatgtgcaggatgtgcaggtttgttacatatgtaaacgtgtgccatggtggtttgctgcacagatcaaacatcacctaggcattaagctcagcatgtattagctattcttcctgatgcttgccctccccctgcccccaccaaacaggtcccagtgtgtgttgtgtccctccctgtgtccatttgttctcattgttcagctcctacttataagtgagaacatgcagtgtgtggttttctgtttctgccttagtttgctgaggataatggcttccagctccatctatgtccctgcagaggacattatctcattcctctctatggctgcataatagtccgtggtgtatatgtaccacattttctttatccagtctattattgatgggcatttgggctgattctatgtctttgctattgtgaatagtgctgcagtgaacatatgtgtgcacgtatctttatagtagaatgatttctattcctttggctacatacccagctatgagatttctgggtcaaatggcatttctgattctaggtctttgaggaatcaccacactgtcttccacaatggttgaactaatttatattcccaccaacagtgtaaatgcattcctattgctccacagcctcgccagcctctgttgtttcttgacttttttttttttttttgagactgagtctcgctcttgtcgccaaggctggagtgcaatggcatgatctcagctcaccacaacctctgcctcctgggttcaagcagttctcctgcctcagcctcccaaatagctgggtttacaggcatgcaccaccatgcccagctaattttttgtatttttaatagagacagggtttcggcatgttggtcaggctggtctcaaactcctgacctcaggtgatccgcccgcctcggcctcccaaagtgctgggattacaggtgtgagccaccgtgcccggcctgtttcttgactttttaataattgccattctggctggcgtgagatggtatttcattgtggttttgatttgcatttctctaatgaccagtgatgttgagcttttttcatatgtttgttggccacatgtatgtcttcttttgaaaagtgtctgttcatctctttcacctactttttaatggggttgttttttttcttgtaaatttgtttaagttccttgtagattctggatattagacttttgtcagatggatagattgcaaaaattttctcccattctgtaggttgtctgttcactcgggtgacagtttctgttgctgcgcagaagctctttagtttaattagattccatttgtcaaattttgcttttgttgcaattgctttttccctgcatgtgacagacacacatgcaggaagaatgccatgtgaaggcagaggcagagattgggatgatgtgtgtacaagccaaggatgccgaagatctccagcaaagcccaggagtgaggagagaggcctggaacaagttctcccacacagcctcagaaggaagcaaccccgtccacaccttgatcttggacttccagtttgcagaactgtgagacgatgcattctggtggtgggagcccccagtacacggtgctgggttgcagcacccagagccagacaacgcaccccacgaggaagctgagcttgacaactaagaggttgcagttttccaaggtggagacatgtttgctcatgtctgtccacgtttttccttttatggaatggagcccttggtacacgtcaggcaacttgctgaacttttagaaaactgatcacaccttccctgccttccaagagtcctcattcttggggacagaatgtacctcataacttggtgtgtccttaagactgtctccgtgttgagtgctgggtgattttaggagtatttgtatgtgtatgtccgtgtgtgtgtgtgtgtgtgtgtgtatgcatgcatgcgtgggtatagatgtgtgaatgtgtgtgtgtatgagagtgttgggtgtgaatctgtctgcatgtgcatgtgtatttgtgtgcatatgagtgtgtggctgtgtagaagtgtgagcgtgtgtgtgagtgagctctcacaggaagtctgtcaggggctttggcccctcgtcactctggaagtagaggctggagaaagagaaacccaccacagggtctcttggctacacatagacagggcggggtcttgctgtacctggggaaggtttgggtctgcgatggggcacctcaccctcaggaggagctgagtgtgtcctgagccccccacagcctgatcctcagggccggctgccacgaggcttagcttgatgccccgctcaccaaggaagcccctgggactggatccacaggaccaacaccaatgaaaaggggaaaggtgggttgaaacatttttgcaaggagaaaacactgcatagaactctattgtcttacaattggggctaatttaacaagacactgtatgtccacataacagaaaattatgcagccatcaaaagtgaaatttgaggaatttttagtgcctgggaagctgcttctgatggatggaaaatatcagagttcaaaatggcggcgacagtgtcatcagactcaggtgttgtacaaacttcctgggttcgaatttggactcgccactggccgggtgtgcatcctagggtgttaccaacctccctatcctggtttcttcattggttaagtgggaacaacaagagtaccaaccccacaggccaaagggtggcatttaaggggctcttgatgaaaaagccctgatttgtcgcatctagtgacttcggtggcaaatactcccataatggccaatatcacgctcccagtgacttaacaacctattgacagaatttctgaaaacttaagtcaccctcacaagccagccagggctaactccagcacagcacagctaggggctttggggattaaataaatacatgctttgagcaatgcataacacaaaagataaataggagctatcacgtccactgcatcctatttcgacacaaattgccagaaaaataagtaaaataaaaagaacaatgtgtgtgcaaaccatggtatgtggtggactgagggtggtgattacaactctgtccatctgaggtccaaaggataacttaaaatacgtgtatggctggttgggcgtggtggctcacccctgtaatcccagcactttgggaggctgaggcgggtgaatcaccagaggtcaggagtttgagaccaatctggccaacatggtgaaacctcatctctactaaaaatacaaaaattagctggatgtggtggcccgcgcctgtcatcccagctactcaggaggttgaggcaggagaatcgattgaacctgggaagtggaggttgcagtgagctgtgatcttgccactgcactccagcctgggcagcagagtgagactcttgtctcaaaaaatacatatatggctaaaaagaggttcactaaaatgctgagagtggtgggatcatagaccgtatgtgtaagttggcaatttgtcctagttttgcacaaggagcacatgtgatataatcatttaatgtcatttaaaggagggaggagttctgaaggtgggcgctctaactcttgggataggaccaagggaatgaagcccccaggggcttggggaaaggcgtggtcatcacagagagtcagggaggactgcctggggtggagagaggctgctgaagggcctgtccccatcaacacccattaggtgactcagctttcatgacaccttcactccttccaatctaaaggggaggctttttcttggcacaacctgcctcttagacacagtgagagggaatcagccgggctttctgtctgggcttgtgggtggtcctgacactggatgtgctgggttgaataatgtccccccaaaactcatatccattcatatctcagaatgtggccttatttggaaatagggtctttgcagatggggttggttaaaatgagaccattctggagcaggggggtcctcatccttatgactggcgtccgtatgagaaggggcactttgaagacaggcacaggggagaaggccctgtggcagtggaggcagagacaggagctgtgtggccacagccaggagcgccaaggctggcctggccaccagcagtgggcagagaggctggaagaggtcctcccttagagcctccagaaggaaccagtgttgctgacacctggagtttggatttctggcccccagaacggtgagaaacacacatttctgtttttaagctacccaatttgtaatgtttggttatgggggccccaggatatgaacacactgggcccaggccaggaagccccctagggtcccccccgcaggcccccaactctttaccttcgatcccttcctgccctccctatcctggggtcctccttgaagccacctccactcgaagccacctccacttgacgccatccccagcacccttggtcctctccccctaactgtagttctctccccgccaccccttcccccagccctccgtctcctccgacccgcgccctgggtcccctcctcgccccgcccccgacgtccccgggtcccctcccctcctctgccagcgtctccaccccgctggctaacgcagggctgagtcctcacccagcagcttagggcccctcagaactagagcggcaggagattaagggttgctaatttggaagcagggactgatgttctataaaaagcagggaggctttgggatctgtttggtttttaagtttctaagccattttagaaactcatcctacacacaaaatggtgaggtccgggggatctgtctctgcctcgccctttcccctccgggatcggtctcttcccctccccacctgcctcctgggaccctccaggaggagaggggcctgcagcagggagaggagtgtcctgtcctggaggaagagctgggaggagaggaccctcccacagttctgggtgggaatggtgggagggtcctagggcctcttgcgccagggcagaggtggagggggcgtggaggtgggtgagtggccccacagcccgtgtgcccaccacggccctgccaacagcctgtgcatttcagaaaagcatcatagcccgtgaggttgtggcgtctgtggtcccagtgctttgggaggctgaggtgggaggatcacttgaggccaggagctcgaggctgcagtgagctaagattgcgccacttcactccagcctaggtgacagagcgagatcctgtccaaaaagaaaagaaaaaggctgggcgcggtggctcacccctataatcccagcactttgggagggcgaggcgggcggatcatgaggtcaagagatggagaccatcctggccaacatggtgaaactcgtctctacaaaaaatacaaaaattagctgggcgtggtggcgagtgcctgtagtcccagctactcgggaggctgaggcaggagaattgcttgaacctgggaggcgaggttgcagtgagctgagatcgtgccattgcactccggcgtagtaagagtgagactctgcctcaaaaaaaaaaaaaaaaaaaaagagagagagagaggggtgcgggggttggcgagggggaagaaaagctttctaggagaagaaccccagggaatgagtctctcttgttgacatcattgagccctgggggaaaacattttgggtgggggccttccagagatgctgtggaagtaccataatacgtgccagggacacacatacagacatctgtgcctcttgaagccggggttagcgaggcctgggttggaagagcagcacagctttcttctgctacagaggaggcattcagtgctgaaaaagccagaatgttgaagatggctgtgaaatgtcattttactcattttcccatctttctcatcagggagccagggagcaagctcagtgactttggaaagcagctgtgtggacccacacgtgcacacacaggcacatatgtgcacgcacgtgcccacacacagccataagggaaagtatgtggttgtctcagctcagtagtgagcaggttacgtagaatctggaagccttgagtgaacccattccaattcctctctgtcggcggaaaatacactaagtggttttttgtttttgtttttgtttttgaaattcactcgaagtattttttctgcccatcacaagccatttcattcataagccaaacgttcctccctcaaaagctcgttccctgtgacgaggccttcgtgttctcagagaggaattccgggatgtttgtttggggacataacatctgctgtgtagctgtgaaaaggaaggatgcaaagccctcagggcaggaggcacccaaggcagaacggtgacagcagagtcacagggtggcccgcagctcccgccattcgtattactatatgtccccatgtaattaggtacagggaacccgggcagggggaccctggtgtggtgggagcgtcagcttagggatggccctgccccttgtcctctggagacttgaggctgctcctggcctctcaggacacagacctgggtgggagggcaggaggtgacaaaatcagggatgccccagcctggacatggcacagggagatgtttacggggcaaccttgtcccttgacgtcccttctcaggaaacaaagggtgtcaggctgtctagtggcaaacccagccctaatccagccctcgtgggtggggtggaagggtagtggggagcagggcaagatgtttggctctcagaaaaggtgccgcctgtgacaacccaccctccaaatgtcttttttttttttttttgagacagggtcttgctctgtcacccaggctggagtgcagtggtgcaattataactcactgcagccttgaactctcgggctcaagcaattctcccacttcagcctcccgactagctgggactacaggcatgcgccaccacacctggctaattttttattttttgtagacacaagttctcctccctatgttgcccaggctagtctcaaactcctgggctcaagtgatctttctaccttggctttccaaagtgctggaattacaggcacgagccacctcacccatccctaatgtctttttttttttttttttttaattgagatggagtctcgctctgttgccaggctggagtgcagtggtgctgtcttggctcacagcaacctcggcctcctgggtttaagccattttcctgcctaagcctcccaagtagctgggattacaggctcctgccaccaatacctggcctaattttttgtacttttagtattttagtagagatgggatttcaccatgttggccaggctggtttcaaactcctgacctcaagtgatacgtctgccttggtctccgaaagtgctcggattacaggcatgagccacggcgcccagcctaatgtcttcttttaaagtcagtttattgaaatacaatttttatttatatttctttaggtagcataatataattgatagtatcatataattctatgatacaatttggaacagaattatgtagtataatttactggtgtatatatatattattatcattttataaaatgagatagtataatctatgtagtataatatagtgtataatagtatgtaatttacatgatatactggtctatgatttttgactaatacatacaatcatgtgatcattgttatattcaggatcgagaacagacccatcacctccaaaaatcccttccaaatgatgttcctttgcagggtcccccacctctggcccagtccctgacagccacaggtctgttctctgtaacatccttcggcctggctcctttgacagacacaagaccatggaaattggcctctgtcatcgcagtactgggtccctgcagctggagggtgtggccttttcagtgatcctgtctctcctcttgtgttttgttttttttctgttgttgttgttttttttttttttttaggtttaaatgttatttgttctcaaaccagactttattataattttactttccagactttaatggaagcaaacccagccataacatttgaaaatacactacttagcttatctcgttttcaactgggagaattgccatgtttgacgatctgtcattacctaggtgacgatcttaaataattttgcattcatttcaacttcctgaaatgtgtttcatagaacctcccagggactgatattgttaaaataaaaaacagaacccacagaggaagtccatttccaaatttagaaaagattgcactcagcaaaattcacgaagcatctcatggcttctcctcctcgacctgacaactgttcttgtcaccgagtaggctcccctgccttccagaagagactgtcagccacatgcatgacaccggcatgtcttgaggggctgtggtctctcccctgctactgctcactgaagagttcgagtgttatgctctactggaaccccaaagcctgcatgtccctttctgctgtggcttctctcctttccttttaaagcaaatgcttatgtaatcccgcagtcactctgtgacaggtcctgataagcctttctcacgttaactcattaaatcctggtgaggccctcagagccaggcgttgctctgggcccccctgtgccaacagctccccaaggggctccgacagaaggacactggtattcatcatttgctgcagctcttagacaactctcccggcagggaagttctctgttcaggctaatgaaagtccctccttggctcttccatgccccacaaggcatcccaggccaccattcctaccgccctcaaagactctggggagaggagccagttacagagggaatccaggtccatccctttaaggagggcacatcccagactgtcccaggggagcctgtgcagtgccagagggcctgaagccagtgggcagagagagggctgctgcagtcggtggggaggaagtcaccccttctccagctccatgatgctgcctcacggtgaggatgcccacatcctgggcaccccctttgtctttctctgcccaccgcacaaacccagaggtgggagggaaactcatggtgaggtgaggtgctgtgactcaggagagctggagtgtggaccatgtccatccccaagtcctggcctttcctgttactctctatcatccagtgacctgagtgatgcttccaggagatggaagagtttcggggcaaaagcccagaccctagaagtccagatggtggccataagaatgtaggagcgaactggacttggtgaccacctgcagtcctgcacaggaaagccctggagggaggctcttggggaccctcttggggaccctctcggtgccctgttatgttgtgcatgtaggagacagtgtgagagagactggatgtgagtgtgtcagagtgtgtgcctgcatgagcgaggctgagtgtgtgcgtgagtgactgtgagggtgtgtgggtgtgagggtgcgtgagtcaggatgggtgtgtgaacacacagtgggcaggaacccacacttctgaatggattgtgagtgttttgggggctcctggtgccttgatcaggggtcaggatctctggctgtccccacctccacctggaagaaccagtcttcttcctgacacttttctgggcttctgagcctgggcttggcatcctctctgcagcctccgagcctgggcttggcgtcttctcttcagcctctgagcctgggcttggcgtattctctgcagcctctgaggctgggcttggcatcctctctgcagccttcgagcctatgcttggtgtcctctctgcagcccccgagcctgggcttggcgtcccctttgcagcctttgatccttggcttggtgtgctctctgtaggcagccacctagggggagcagcatggagcgagagtgggcagtgggcgccgactccatgccacgcctgctatgaaatgctgattctaagctgggaataaattccttgctagaagaacatgctgtgcaaggtggaaaaggaacaaatagaacctccccacgcctcccacatgcgtggggctctggcagggaaagagatgactgattgctgtcgcagaagcgcagatgcagggagcaacccgacccacacctccatggcatggcaggctaattcatgttcttcctcatgatttcttatgttgtgctacctccaaggagtcactgtaaacattcgctgtaggattactccgttccccccttcgttcctgtaacacatccaaacatgtaaaacaagtcatttgaaagttagactgataacatccagactggagtaggatacatccaacaattagcttagtctggttttataggcgtgtattcttgtgaaacaggtccgactgtgtttaccctttccgcagggaaaatctagtggagacgcggctggagttgaggcatttgcagttgaggctggatcatggtccactgtgctggctgagtcccccagccccacttccccaggtgatttggaaaccttgctgggcatgtttcagcagcaaatcaggcaagcctagtcccatgtctttgggttgacctggagacctgactgctgggaatgcccacagccctatctcaaagagcgtgctccgctcccaggccctactggccccttcttggcttcagctgagttggtcaagagtggatgggctcccaaccccagagaaactcatgcggctgcctgagaaacacactgacacgcagagggctgaacaggaagggaaggactgggctggtcgtcttcctggttgtgataactgactgggttggagcaaaagttaaagctgcaacatggtcagcaggtgaaacaggagtcgtgagagatccaaggctggtcagatttgtgtgagtgggaagattcagtgagctagagaaagcactaagccagcgcagtggaggaccagagagaaaactgctgtctttgtcagctgggctgctatggcaaaataccacagactgggtggcttacacaacaggaatttatttctggaagtccaggattgaggttctggctgattcagttcctgatgagagatgtcttcctgccttgtaggtgactgccctcttgccctgtcctcatatgatggagaaagagagagcgctctggagtctcttcttacgaaggcactcattttgtcatggcctcatttaaagctaatcacctccccaaagccccatctcctaataccatcatactgggggttagggcttcaacacaagaattggcggggagacaaacattcagtccataccagcagatacgggagacctgatctatggcacaggcctcctctagttcattccacgatgctttgcaccgacgggatacccagttcagggttgccaaggcctgtccgaaccacatgtcagggtctcgggcattaggaagttctgtcacctcctaatttattactccgatgacaggaaactccaccctctaactttcgagtcttaggagagtctctgtcccttgataaggggggcgggggggtgggggtaaggaagaatccaggccaggcatggtggctcacacctatgatcccagcactttgggaggctgaggcgggtggatcacttgagatcaggagttcaagacttagcctggccaacatggtgaaaccccatctctaccaaaaaaatacaaaaaaaaaaaaaaaaaaaaaattagccgggcatggtggcatgtgcctataatcccagctactcaagaggctgaggcaggcaaatcacttgaacccaggaggcagaggttgcagtgagctgagattatgccactgcactccaccttgggcgacagagcaacactccatctcaaaaaaaaaaaaaaaaaaaaaagaaaagagaaactctcagttaagtaagtcagtcttctgccaagtaagtttttattttctttttctttttttcttctttaaataataaagatggggtcttgctatgttgcccaggctagtctcaaaggcctggcctcaaatgatcctgccacctctgcctcccaaagtgctagaattacagatgtgagccaccacacctggccccaagtaggtttttaaaatgcagatggtacagggtccagatgagaaccctagggcctgtccactgctctggttggagcattcaaccagctacgtccctctctgctccagtggccctcaccctcactcacctaccagcagcctatgaaagattggtattaactattagatgaaatccagttctattcaaagtttttagagctttgtaaagggcctactgtgtgcagggtaccatgtggggtcccctggaggatgcgtgaatgatggagacacgatgccaaccttccatcaggagaagcacagaaagaatttagccaagaagccagcagggtggagggatgccaggaggaccctgaaggccctgctaaggattaaggcaattatattttacattcctccaaccggagactctggaagtagacgaagtgagcccctgcagtgcatagtgactttcctccaaagagcacagcataggaacggggagggcaaagagcaacactgccatgggaagacctgaccatcgccgcctgtcacatggtcaaggtcaagcgttagtcgggttgacgaggtgtgcccttgctgtgatgcaatacacgtggagctttgcctctgtggtcttccccactaaaactcacagccttcatctcaccgtgagaaaaaaaaatcaggcaaattctgatagaggagcatcctacaatatccctcatcagtcctcctgaaaaccaccaagatcatccaaaaccccgagtcagaaactgtcacagcaagaggggtctaaagacacatgatgactagatgtcacgtgagaccctggatgggatcctggaacagaaaatggatattaggtaaaaacgaaggaaatccgaataatctagggactttagttcctaataatacgtcggtattggttcgctaattataacaaaattactatactaatgttaggtattaataataggggcatggcatatgggaactctgaactatatgctcaatatatctgtaaatctaaaactattttttttgaagagcatcttttttttttttttttttttaaccctgcagcaatgagctttgggatggacagcctgtgaaccagactctccctctctccaggaaatttggtgagctattcagcatctttttaatctctttcttgcttaaactagctgcagtgagagctctgttgtctgcaaccaagaatctagactaatacctgcatttagttatttacatacagtgtttaaaaaagagagagctgcaggagatttggtgtcattttccattttgagctgcgatcatttttaaaatgcaggataatgtctgcaaagtacctggggatagagtcaggactaatgagataatatctgcaaaatgctttgagttccctggagctgctgagaggcaaggaacatgcattatcatcattagaaaaaacaagctttgaaaactttggcaggaaggcggatataagtggaaatcagttcaattactcatgcctttcaaaatagacaagttctataaaagttaaagtattttttttttttgtaaatcaaattcctcttcatttcctctgtcaaacattactgttctatgatctttcaattatttttggttggactccctttgacaatgtattgaagcagctttcgtttctctgcttccagattctctggcagaatattctcaaacttcaaatctatctccattttgagaaaatatacaaagcatatgctttcttttaatgttacttgaaatttcaaaacaacatggtgaccaaaactaaaccaatacaatgataggaatagaagaaaatattatttttatttttcaaattttttattttatttatttacttacctatttattttttgagacagggtcttgctctgttgcccaggctggaaggcagtggcacgatcacggccacagcctcccaagtagctggggctacaggtgtgccccaccgtaattggctaatgttttatttatttttgttttttgtagggagggcatctccctaggttgtctagactggtctcaaactcctgggctcaagcgattctcctgcctcagcctcccaaagtgctggaatttacaggcgtgaagccaccacactcggccatctttaaagatacattaaaaaaatttgtcagtttatatatgagtaagcttggagtcttgcattggcatcttctgaagaagagggagaacagagctcatcatgaccctttcaacatctagcctaacgcactgttttgttttcaaagtccgtaggaaggaaaaatcaaatatagacgggtaaaaatagaaaaatgataagaatgctttctctcgttttaaggagggagattttacctagcaattctccaaagttcttgtatcagttaagactttgttgtgattaacagggattatcatctcccattctacttgggttacctgtgacccaagctgtttttcttctaaaaccttacagaagatcacaagaattagccaacacattctaaacatttcctaaaacatcccctcaaactatcataatggataaatgacctatttcttaagatataattgaagacaatttaattaactattttgcaaacatgtaataagaattcctcgtttcaaaactgggctagaggtatcctcactgttctctgggcaatttagcttgttagtgtttatgatttgcaacacttacctcctggcaccaaattcagatttagcaaagattctttatgtggcaagtaattagaaacccaacttaaactgtcttagatgacaaaggagattcattggttcccattatagaagtccagaggtgggcagatttccgggcaggttgatgcaatgactcagttatgtaatctaggaagcccgtctgtcctttttctgttccttttgtagacacagttttatctagggacccatttcctttatagacttgtaaatgtcaaagccaagccgggtacagtggctcacgcctgtaatcttagcactttgggaggccaaggcgggtggattacctgaggtcagtggttcgagaccagcctggccaacatggtgaaaccttgtctctactaaaaatgcaaaaattagccaggcatggtgatgcacgcctgtaatcccagctactcgggaggctgagtcaggagaatcacttgaacccgggaggtggagcttgcagtgagccaagactgcgccactgcactctagcctgggcgacagaatgagacttggtctcaaaaaaaagaaagaaattcttggtggtgtttcctggtacagatagaatattaggaggaaagaggatttcttgataagctctgaaataggatttttcagccatgatatctagaaaatagtcccccaattcagcctaagcatgcactaggtaaaagtttatttttctgtgaaattatcttaagaacattgtgtttgaaagttttatgttgaaacaaataaatagaccattttagtaatgattcctgacatctgtgacttgatttgagctctaaatgttttaataaggcaaagttcatattcaaacttttgaacatagttgtctaatatgataagctttgctggaagatcttttgaggagtttcttttctctagtattccaaacataggatacctgtctcaaccagcaggtaaaaatgcttattttcctttgacaaccaataaactccagtacccagtggagcagcactttctgattggcattcagatcttcatccagagcaaagcaaaacatctgggggttgacacacagtttttcatttcattgattatctttagttgaagttttcttatcgatttctggacagagttttgaaaggtaccactgatggtccatgacagagcacacaccagaaatgagtgtttttcctttgattttcactcagtatcagcaaaccccagttcatctggagcactagcatggcaaaaccccattaagaatgtttttttttttttttttgctatttagcaaacttgcttagaagaattttcatgcagtgttaaaaattttcatgcagtgttaaaaatatcataagggactgggtgcagtggctcatgcctgtaatcctagcactttgggaggctgacgcaggtggattatctgagctcaggggtttgagatcagtctgggcaacacagtgaaaccccgtgtctaccaaaatacaaaaaaaaaaaaaaaaccaaaaaacaacaacaaaaaaaactagccaggagtggtggcgtgcgcctttagtcccagctacttgggagactgaggcatgagaattgcttgaaccgggaggtgaaggttgcagggatctgagatcgagccactgcgttccagcctgggtgacagagagactctctctctctctctgtctctctctctctctctctctctgtctctctctctctctctctgtctctctctctctctctctctctctgtgtatatatatataaaggttttatgatgatctccaaggtcccagaaaccacaattcttttccaacagaatctcgagtcattgtgcctagacgaatgaccatactcaatttcctttgttatcgtaacagggacaagagaggtgttatatcaatcttttgcaaaacttgaagtttcacatcctaagctaattcagctaatcatttttcaattgaaaaatgggactggcttaaacagcaatctgaaacattctgtcagattcctctccaaagaaaactttggcagctgtcagaatgcaaattgtcacacaagttccactgccatgataggttagcttttgttgttgttagtgttgttttaatcttgaggatgggaaaggctaattcatacagaatctacagcaccttgtccattcccaagagtgtggtcttgttctgtccaatcttctgtgctcctgaaaatgctcctttgctggaaaaacaaatgtataaacatataaaaattcttcttaaaatattttgactaaaatattatttaaatcaagaatttctggcataattacacaacatttttggaaatgtagcatactgaaagaaatgctccattcttttgcatgaatccatacatgacagtaaacattgtcaaaaattttgatgacatcttcaaccctccccacacaaagctctgtaaaaacgaaaggttttggcaaaaacacttggtcccacacttgtagaatgacaatattgtatcgacttgtacagataaaaaccagcccatcttcaagtttggttgctaggagcaggaaactctaatatgatgcaggaaatatatttgcttccgtggaaaattgtgcattttcttagtagctagaactccagggtatctgattttagcctttcgttgtctttgagctatttcatacctcaggaagttgtagataactgtgttagttacttagggctattgtaacacagcaccacaaattgggtaacttagcacaacagacattgatcacttcacagttccagacgttactggaactgaaggctccagttcagagcttactgagactgcaaccgacgtctcagcaagaccaagccctctctaaaggctctaggagaggttccttcccgccctcttcccagctcctggcagttgctgtcaatgcttggtgcttcttggtttgtagacgcatcattctgatttctgcctccatctttacattgccttctccactgtgtgtctgggtctctgtgtccgagttgccctcttcttataaagatatcagccatgttagacttacggtctactcttctccagtatgacctcacttaacattattatgtctgcaaagaccctatttccaaataaggtcacattcacaggttctgggtggacatgagttattggtggacactattcaacctagtacagtaactgatagcaatgagaaataattcttgtttatagatatgcaaattctgtcatgttcagaagaggttcaactgacttcttgcccagccaccttggaaaatcagttttgccttaatttgcacaatcatttccatattcctgatctagaaacacatctgctcttcagattatctttaaactggatggaacacctgccttgttccttcatttatggaagaaaatctttaataagcattcatttgtatatctgtaagggagtcatgattttttttgttttctttttttaaaattatctttaacagtgaaaaggggagaaaacaggaagcacaagggaattcccttccctcccatgggccagggccagtcctaagcaaagtgctgcagaagggcaaggctgtcctgagcaaccttgaccacctactcaataactgctccaggctgggtgtggcttcatgccagctctttgggaggtcgaggcaggaggatcccatgaggccaggagttccagaccagcctaggcagcacagtgaaaccttgtctctacaacaaataaaaaattagccaggtgtggtggtgcatgcctgtagtcccagctactagagaggctgaggtgggaggatcgcttgagcccaggaagtggaggctgcagtgagctatgattgtgccactgtacttcagcctgggccaaaaaaacaaaacgaaacaaaatgaacaaacatgctccaccctctcagttcatcttcttgggttctctgcacttcatctcaagtggtgggggtccttacttgaggcctgagtcaaagactttctcctgaatctaacccaccttcctgcatccatatgctcaccatccccagtggctcctatgcgagccacagttgggagatatctgaccccttttttccaccaaactcccccaccatgctgctgctgacccaatttcaccactgctcagtgtgatttctagtaatgaataataattagactctgagcctgctttccccagtttcatcctgtgctgcctctgaactcacgtgatatcaaaaccttttttttttcttaaacaattgattcctctggcatagcaacaaacagatagctagaaagtcagctctgtaaattgagaaacttttcagataaatcattatttgtatttttttattgctttttttttctcatttgcctctttagtaggtgatttggcgtaagttttcaaaagcctttcaaagctatatggagccaggtatggtggcttgcacctgcagtcccagctactcaggaagccaaggcaagaggattgcttgagcccaggagtttgaggccaacctgggcaacataatgatacccagtctctaaaacaaacaaacaaaaagtacaggaacaacaaaggtatacaagaaaacttttggaggtgacgggtaggtttattacctcagttgtggtaacatgaggctgtttatatggcccagctcaccaaattgtatatagtaattaggtacagttttttcatatgccaattatgcatcaataaagctggaaaaaacatataaataattccacttatagaaataattataagcatataaaagacagttgagccaagatagatacacacggcggtgcattgcgcttttgtttacaacagtgaccactggaaagaagccaggggcccatcaccattggattgtttgaatgaatgatggcatgtcaatgccattcagtgctacacagccacgaagaaggccgcagatttgtgttgttagcatgtaagttggcatgtgttagcgtgtgtgttggcatgtgttagtgcatgtgttagtgcgcgtgtcggcacgcgttagcgtgcgtgtcggcgtgttagcgtgcgtgtcggcatgtgttagcgtgcgtgtcggcatgttagcgtgtgtgtcggcatgtgttagtgcgtgtgtcggcatgttagcatgtgtgtcggcatgtgttagcgtgtgcgttggcatgtgttagtgcatgtcggcatgtgttagcatgtgtgtcggcatgtgttagcatgtgtgtcggcatgtgttagcatgtgtgtcggcatgtgttagtgcatgttggcatgtgttagcatgtgtgttggcatgtgttagtgtgcgtgtcggcatgtgttagcgcgtgtgtcggcatgttagcatgtgtgtcagcatgtgttagcacacgtgtcggcatgtgttagcacgcgtgtcagcatgtgttagcgtgcgtgtcggcatgtgttggtgtgcgtgtcggcatgtgttggtgtgcgtgtcggcatgtgttggtgtgcgtgtcagcatgttagcatgtgtctgcgttagcgtgcgtgtcggcatgtgttagcacatgtgttggcatgtgttagtgtgcgtgtcggcatgtgttggtgtgcgtgtcggcatgtgttggtgtgcgtgtcggcatgtgttagtgtgcgtgttggcatgtgttagcgtgcgtgtcggcatgtgttggtgtgcgtgtcggcatgtgttagcacgtgtcggcatgttagtgtgcgtgtcggcatgtgttggtgtgcgtgtcggcatgttagcatgtgtgtcggcatgtgttagcgtgcgtgtcggcatgtgttggtgtgcgtgtcggcatgttagcctgtgtgtcggcatgtgttagtgcatgtcggcatgtgttagtgcatgtcggcatgtgttagcatgtgtgttggtttgctagggctgccataaccaagtcacagaaaccaggtatcttacaacaacagaagtgaatggtctcatgatcctaaaagctagaagtttgaaatcaaggcatctgcaggacaatgtaggggagactccttcctgcctcctccagcctctggtggctctcagcaatccttggcattcattagctttaagcggcatcacctcaacctctgcctctatcttcacaggttcacacggccttctctctgtgtgtctctctcctcttcttttcttttttttgagatggagtttcgctcttgttgcccagtctggagtgcaatggcacaatctcggctcactgcaacctctgcctcccgggttcaagcaattctcctgcctcagcctcccaaagtagctgggattacaggcacctgtcaccacacctgcctaattttgtatttttagtagaggcagagtttcaccatgttggtcaggctggtctggaactcctgacctcagatgatccacccgcctcggcctctcaaagtgctgggattacaggtgtaagccactgcgccccgccttgcttcgggtggtttttctaacttcagggctgggaagcagccactctggtgggaaagattatacctgcccataggagagactggtaggagatggagaaaccttccagaagggggagaagtcaatggattttccaggtgttatagtggaagaagctggcaactccagatcaggcctgtggttgtagaaatctgtaaggttctggaaatgcttccatgtttgttatttttatgctcctgtcctgggccacaaggaaagaaggcagtcagatcggaggtgactgtgtcctactacacaactggagaagggctgaggtgtggctgcgggaaggaggaatgtgctggaggaaaaggaccccacagctgctgagaggctggactgctgccctgggctcggggcgggggccccaaggtgattctccagtaccttacttttcgacacctgaagcattggaggtgtggacacgacattgatgacctctccgcctaagcccttcaccgtctttctctgctgccatttttaatcttccagaattgcacccagtttttaagtggctggtacccttgccaagctgcccttggtttctccagtttgtcttctgaactctagtatgactggaggctgcttggagcagggaggaccaccgcacagccccaggacagttcaattagagaagcaatgtgctgtgttctaccagcaacagcaggaatgccaatcctaatgcttatgcaatgcttcttatgtgccaggcgctgttttaagaattttacataaattagctcatttaatcctcaccaaaatactatgagaaaggctctattctcactcccatctttatagataggaaaatagaagcataaaggggttagacagtagctgaaagactgttccacttgtcaagagaagctgatgcatttcctgagcctagggtgttataatgtcccccagaaaaagcccatccgaaggccagggtttttgtttgagacagagtttcactcttaccgcccaaagctggagtgcagtggtatgatctgggctcactgcaacctctgcctcctgggttcaagtgattctcctgcctcagcttcccaagcagctgggattacaggtccttgccaccacacctggctaatttttgtatttttagtagagacggggttttaccattttggcaagcctggtctcaaactcctgacctcaggtgatctgcctgccttggcctcccaaagtgatgggattacaggcgtgggctatagcgcccggccagaaaaccagtgtttattgttggtcttgtgggctgggagctaatgagcacattcttcaatatcagtggcactctctgggttaaacgtgcagcaataggtcagaggacacccggggtgggcattcccaaccagtgatctggccctggggaatttggggtaaacaatgatttgaatcgtagttaagctcaagagccaacaagaaatgcctaaactgtgagtagtgctacagaggatcctgaaatccaatgggctgcttggaatcccctccctgaggacgcctggaactgggagggagccttcctccctaggaattccattctcagtgggaggccacagggcgtggagcactagcactgaggtggttcccagggcacctcttacaggacaggggctacaggaatcaagagaatttctgggatagggagagagctggggcagtgggtttagcttccttctgcatttactaagggctaattaataatcataactaatattgagtgcttgctcagtttcaggctccacactagatgcttctcatgcgttgcctttctctgtcttccattaccacttcgtgaggcaggtgttgtattcctggacagggatacataacttacccaagctaaaaagagctgagtttttaaaaaagggccgggcatggtggctcatgcctataatcccagcactttgggaggcccaagcaggaggactctgtacaaaaaacaaaaaaacaaacaaacaaacttattgaagggttgcaaacattcagaaaaatcttaagtatatagattgatgaaattatgttaaagtgaacccattgggacaacagataggacattcccagtgcccccaaaacctcccttgtccacttcccaatcactaccccttcttcctcccaaaaggtagacactatcctgatttccagcactagccattagtttagcctgatttctaagcttctgtcaatggaatcatacagcatgtgctcttctgtgtttggtttcttttggtcaacgctaagcgggtgacattcctttatgctgttgtgtgcagctcacccgttctcactgctgtgcggtgctgcactgatgattgtgccgcaactactctatccaatctactgttggggagcatttgtttcctctctttcttttttgccacggtgaaaaaagtttccgtgaacattcccgttcacgtctttgtttggccacatgtacacatttctgctgggtacgtgcccaggagtggaatgactgagtcacagggttggtgccaggtggggttttgagcctagacatgcctgctctaaactcaagagcggtgccatgccatagatcactgtgtggatgtggaggcctacagaggagacacctgaggtggcagtgggaatggagggggagggatgagaagcaggagctgcagagggaggcctcctgggcagatggcagtgctgtgttagtcaggcttgggggagtctctaggtgcctgtgtgacccccaggaggcactatccagggtgccgtctggctatgcctctttaagcttgatgggaaccctgggtgtgagggggccagccagggctgaaggtaaggtgcctggggagggaggggacagagacaagccttgtgccttgggccctcaaccctcgccactggagagtgatgttgcctgctcagaccaagtggggtgggactgagagaaagtggtgactgtttataaagcaaggccaagtgcaagaactgctgagtgactgggaacttcctgtgtgcagaccacacctgctttttttttttttttttttgagagtcttgctccgttgcccaggctggagtgcagtggcacgatcttggctcagatcctgggttcaagcaattctcctgcctcagtctcccaagtagctgggattataggcatgcaggcatgcaccaccatgcctggccaatttttgtatttttagtagagacagggtttcgccatgttggccaggctggtctcaaactcctgacctcaagtgatccacccgccttggtctcccaaagtgctgggatgacaggcgtgagccaccatgcccggccgacacccgcatttttaagtagccttctttttcagcagtgtgacttttgcggggcaatactcagcaaccaggatgatgtggagcttccggaagccaagggcaggccaggagacagtttgataagaggggcattcacgtgagactgcctagtgacctgaggcaggaaaggagacaaactgcaagagcagggttgtggtgctgggtggtgaaaagggttgagccattgccccaaagggtgtcagaaagtgaagcattggagaatcaccttggggccgccgccccgagcccagggcagtggtccagcctctcagcagctgcggggtttagggcacagcctcaaacctttaggggcaatctgggtagtgaaaagggttgagatatttaggggcaagtcctagggcaaggtcaaaggaggtgcggaggtcaggagagaggccaggtggaaagctccctaagccacctgaaatatccacagctagaataaaacaaggcagccttttcccaatacacagaaaaatgctggctctagaattcggccagctccattttcagtgtcttttacaccaacattttaactttaccttcagtgccttttactgcttagtggcaaatgttcctagatgaccatgggaatcaatgagcagaaagcactgtattgatgactggaaatccttactgagagacacactcatcttcactggagagcttgtgtatgtatatgcatgtgtatgagtgtgtgtgtgtgtgtgtgtgtgcatgcaggtgtgctgggtggagggtggggggcacttgttgtgatttcatattgtgccaataaaagcagattttacgctggtgagagtgatctcagttcatggggtggacgtatgtgtaatggacggtggtccccctgcggccctctgattgtgcagtgatatctgggaagtctgagaaccgcatcagtgtggggtggactggataggacgagaggctggggacggtgggaaggtgcaagaggaagaagcagtggaaaggagctgccaggtgttggagacagtgtgagggaagtgaggaagcggccccaatagagggcccaaagcaagggtccctagagtgctggagtggggaaaaggaagggcattcagttgtagatatcattagggcttaggaaaaaaagacttaaaaaatacactgatggagttcagacaccttcttcaaagggtggatgatctgaaactaagggagaggtgagatttggttccattcttctgacaacctggggaagggcaaattgggccccagaatctggaactcaaagacagacagtagagattgagttgaggtgcagtgaaaaatcatatgtaagagagaaaaagaggctgggctcagtggctcacacctgtaatctcagcacttttggaggctgaggtgggcggatcacctgaggtcaggagttcgagaccagtctggccaacatggtgaaaccccgtctctactaaaaatacaaaaattaactggggtaggtggcgggcacctgtaatcccagatacttgagaggctgaggcagaagaatcgcttgaacctgggaggcggaggttgcagtgagctgagattgcgccactgcactccagcctggtcaataagagcaaaattctgtctcaaaaacaacaacaacaacaacaaaaaccaaataaataaataaataaataaataaagagagagagagagagaattcttatatgaagtcaaaaccggctgtgctgctctgtcctctgaggcatgcgtgtatgtgtgtctggtctattcccctcaacagactatactttctgctccaccacctaaacttgagagttttattgaggtcctgttcttttcggtgacatcccacctcttcagcaacaccttcccgcccttccagtttgagtgctcggtagctgcacatcctgtgaacaggttgcacacacaggaatctcaacattatgaataactgcaagcaggatgacaccgggatcctcttctctccctcccaatgcctgcagtggatatctggactacatatgtaagtaatacatcaaactgagtaaatactattgaggaaaatgtttacaagggatgggaggggaagtctatgccaacaaagagaccagaagccacaagccccgaggcatcctggcaggtctgctgcggggcctgggagccggctgctgacacagggaatgtgggcatgagtcaccggtgggggcttctgaggaggaaaaccatgacaaagtgtgcatattgagaagtggagtgtgcatctgccgtgctcagtaagccagttgactgaataactccagattaggagagagaatagaacttgggaatttttatcattataaacttggggtatttttggttctaaaaatgaaataccaaaatgttctggtgaattgtctgagagagtctaaaccctatatacatatacagccatggaaacagaggcagtcgtactcaagtgcaaaaaaaagtgtgctagtgaaaagtagtaatgggccaggtgcagtggcttgcacctgtaatcccagcactgtgggaggacacagcaggaggatggcttgagcccaggagttcaaaaccagcctgggcaatatagcatagggagaccctatctctacaaaaaataaaaaattagccgggcatggtgatgcatgcctgtggtcccagctacttgggaggctgaggtgggaggattgcttgagtccaggagttggaggctgcagtgagttatgatttgccactgcatcccattctgggtgatagagtaagaccttgtctcaaagaaaaagaaaaaaaaaaagaaagaaagaaaaggaagaaaattagtaaccatcagctccagctccattgcagtccacgtcttaggagcgtggattttgttcccacacactttgtgccagggttgagctgagctttggcactgctaagcatgtcgcttctgggttaggtaggtggagtaggttgctttaggtttagggtcacaggagagctgggctggctcagccatccctccttcacttagtcatcagaaatgtttcccaggcactcaagccacgtgctgctttagcatacaacagggaacagtctctgtcctagagaattcagtcctcagccttgcccctctgcaaggctatgagcagaactccaggctactctcccttcctgtggtctcaggactgccaggggcatggagtatggggatccccactttccagctctgtttacagtgcttggatgaccatagtatggacagctgaagggaatccaggggactgtgtctgtatttcctggagatgatcactgttcaggcaaagcatggggcacatgtcgtcatcaaatatggcttagggctggaaatgtccactgaatttcataggaaagaaacccttgtgggatccttggggaagccagggatggtgggggtgggtggggcaggagcagatggcagcaattcaaagagcagcaggaggaaatgaaagtaaagacattaccttctttaaaaaatgtttattttattttactttttgagacagggtcttgctctgttactgaggttggagtgcagaactgtgatcatagttcactatagcctcaatttctcaggttcaagccatcctcttgcctcagcctcccaagtagctgggatgacaggcacagccaccatgcccggctgacactgccttcttactgtgtagagcataatgtttggggggtttttcccaagaagcgtgaattacttttgtaattttcgattgtgtgtattacatatgtcaaatgaagaaatggaagatgaaaaagtgcagcttgtgcggatctgtcttgcagaaggttcagctgtgagctaagctggtgggggtagcgcaggagcgtgtgggggcgtaaagtctgttgtggagtggggatctgagtgggctgtggatgcagaaacagatgctacaccatgacgggaggacctcagggagggttgggagggatccagagtcccagggaaggagggctcagggttctgctgcaggggagggtcctcttctgtgttccccaagatcagaatgacaaagtcagggatgctgatggctgagcctcccaacatgcagtcgctgcccagcctgcattctccctgccttcatctttgtccccatgggcacgttttgacctgaaactgacctaagagagaataagctgagtgacaagggaagccaaactgtgtgattcaccacggtagtttgaaatcctgatttaggctttgctttgctgactgaatttatgctcagttagggagaggatggggtggcaacttgtaggcctggcattaagcacactggtcccagctgagagccaggcacgatgcccccatccctcctggttcataaggtgctggtctatcagctccagtccccttgcttggtgtccctgaagtctcagtctggcagttttacacgtgctaaggcatgaatccggctttacagagggctgttgatcctcagaagctgacacagaatctgagtatcctcctgagtcccatatttacctacctatggcaggaggttttttaaaaaatcctgaagatacaaagactttgaagtgtaagtggctaaagaaagctcaggttcctggtgatcagctgctctgtgctgaccttgtgtacattcagaagtttccaagatgcagcagagctgggtctagcaggcatcgccttctcttttgtttaacacatctgttgaagatcaaccaagatggtgaggcatccttttagatgctggggattcaaaaagaaattaacgagacctggttcctgctcttggcaaactgtcagcttacagaggaacatagttttgcaaaaacatattggaaagcagggcagtaagagtgattacaggggcatgtaacaggggaagtgatagggaaaagggtggagtttctcctgcacttcggggaaggccatcagggtgggtcatggggaagccctcgattagtaggtcattttttttttttttttgagatggagtcttgctctgttgcccaggctgggctacagtggcgcgatctcgggtcactacaacctccacctcctgggttcaagcaattctcctgcctcagcctcccgagtagctgggattacaggcacgtgccaccacgcccggctaatttttgtatttttagtagagatggggtttcaccatgttagccaggctggtctcaaacttctgacctcatgatatgcccacctcagtctcccaaagtgctgggattacaggcgtgagccaccgcgcctggccgatcagtaggtcttttaataggttctcacctcacaggactccctcaactggccttgtaaatccaaccacatttattctgttgaataaaaggttccattggcaaaagacccaaggccttttgtccttagagtaggcatggattttctagtgataccccactattgctaatcccatgcagagcaggaaaaaggtggcagaactggcagttaagtgcacacatgcatttacttctagacatttaatcacaaagaaaacttccttaaaagaagctgaagttccgaaatggttacatgaattgagattgtaataggagggatctaggtgctgtcaattgaatggagtgaggcccaaacagcaactaatctctttaatagggagatccagaaatacacagagacctttctttatattcctaaactgatgagaaaggtaatctggcctagtgattccacagattgacttcaggacactctaggttgctcccacgagtgtgggaatcaactcagagaaatttgcaaaaactccaaaacaaatcattttggtttttaaaaacatgagtgttttaaaactgttttttaaaaaatgagtgactaagagatgtcccgttccccactcacttcttctctcgtaggcagtgggagagctggaagagcctgttacaaacctcagcccattagcatctcccagctctgtcttttgagaagatgactgagaggaaggtggtattgagaaaacaaagcatccagcctttgtgaagctgagccttaaggtcccctctccagccctggctgaccccagaccctcgttttcttctctggcatccaacttcaaggattggcctgtttccctttaactatagctaccactcagctcactcgctgaagaaggcagagcccacgcctcctggcacagtttcccttcggctacctaaggcaagcgaatgagtctttttcatcgtaatgagctgtatttccctcactatggaacaacaggggctaaacaaattaataaatatgctcagcttttccttcttggtttgtgaattctctctacgttttggctatcatcctaaccacttgccacaagcagcacaattaatgttttttctgcaattaatgttttttccccatttagcttgctctttctttcttttctttcttttctctctctctctctctctttctgtgctgggattacaggcatgaaccaccgcgcccggtcgagtttttttcttaatatgctgttttgctgaactgagttttagttcctagtaacagagactaactctggaaagctttcgtcaacgacaatgaaaacaacagcagcaaaagaaattatcagacggttgttatctcatgagatctactttggattagtgctgtcatgttcccctccaagcattcacacaggaatgtggtcatgtcatttctagaacagtatgaagacaagtaggatctttacagccctgagtcttcccatctgagcttgaggtctggctctcccagtctctctcactgagaacaatttttacacataatactggggtttaaaaagctcaagccacttgaggtgggatgtttttctgaggaaatacctggacaagggtgcatttgtgtccactaaggaaaatgttggaaataccctaaacatcaagaataggagattggtacccccacagtaacagacattcaaaatctagaactattatcattgtaacttagcagtggtaaagccataattggaagccagcctgtctgatatcactatctggtcttcaccccaagctgcactgccttctatacacatttctcattcacttcacctgggctagctctctcggcaaataaggcaatgaatctggagaagcaggtcctacagaacaatttatatcaaggcgaatggatactttaattttcatactaatgaaagttaacactgttgctaaattccagacaatgtgagaaggttttaaatcactctctccttcagttcttcatttagccttgggagatgggaactggttattttattttcttctttggtgagggatggcgtctcactctgtcatccaggctggagtacagtggcacaatctcagctcactgcaacctccgcctcccaggttcaagcaattctcctgccttagcctcccgagcagtggggaatataggcatgcagcaccatatctggctaatttttgtatttttagtagagatggggtttcaccatgttggccagattggtctcgaactcctgacctcaagtgatctgcccaccttggcctcccaaagtgctggagctagttattttatgaacactgtggtgcacttgtgtgctcctccaccactaggttccccctgcctccctccttccaaaccaaggtggggcaggccctataggtgcatgcagttttctctctcttcaagataaacatactgcttgtaattttgaaaggcatgttacagacatataactgagctagtgctgaatttttaaaaaatggtccaaagacaaattattcaactaaatgaacaaattgtgtaattgctatgtatatctttcaaaatcataacaaaataattcattgaaacttgacagtcggataaaatataatttctcagtacttctctttttgttttgagacagggtctcactctgttgcccaggctggaatgcagtggcaccatcagggctcactgcagcctcgacttccccctcaagtagctgggactgcaggcacacgccaccacactaggctatattttgtatgttttgcagagatggggtttcaccacgttgcccaggttgggcttgaactcctggggctcaagggatccgctagactcaacctcccaaagttttgaaattacaggtgtgagccaccacacctggcctcagaatattaatttaagttatcctgagtcggcagttttgataagctactttctcctacctatgcagattttgtacatataataaatgttggctttactaaaaatgcctatgcctgattttgtgtctttttttttttttttggtgttttgttttgttttgtttttgagacggggtctcgctctgtcgcccaggctggagtgcagtggcacaatctctgctcactgcaagctccgcctcccgggttcacgccattctccagcctcagcctccccagtagctggggctacaggcgcccgccactgcgcccagctaattttgtttttgtatttttggtagagacagggtttcaccatgttagccaggatggtctcgatctcctgacctcgtgatccgcccgcctcggactcccaaaatgctgggattacaggcgtgagccaccgcgcccggtcgattttgtgtttcttttagcccatcttccagaaatgtccagactctactgtctttgttgtaaaagaagcatattttattttttatttattgtttcttcttagcggtttatttttaaaagacaggaaaatgatcagcttgcatcctgaatcggaccacttacttataaacgatagttcttctttgaagcagacgatgacattttagtttatatttaaggggaaacacattcaaatgctatttggactcaaatttctaaggaagaaaaggaagtggtaaactctgaagatagaacctcaattcccttgctgagtgacgcggtcaatgagcaccaatcgcctacgggaggccagaaaaggctgcgtggtgctcccctctcagggcctggccctgtccacctgggccttggtgacccgcagccgggactcttgctgtaaagtgacgcagtgctctccctgggaggacagtgggtccagcaaacccaactcagccctcagggggcacttgaaattgtaactaccccaggcctttggaaacaaccctcaaccttgaaaggggaaattcccagtgggaattgatgcaaactgtggtcagttacacaaaaaggtagagtttactgtaatctgggggctatttttggttgcagaaagaatccccggagtagagaaggaggccagcgagtctcagttcgctgctcgctcagagccgcccaggtgcgagggcgtcttcaccagaaatcggtgctcccgcgcgccccaccctccggggccctgcagatgccgggtcgggggccgccagcaggccctttggctcctgctggagacactggaagaccaggcgaccaggacagcgggtcgggccagtgcggtgtgacacgagggctcgagcggcttcgcagtttaaacgtgtcctcatcctacacctcccacggctgtttcggattcggtgccctcgtgcccctcagcttgcccagcggcacgtgggcctcaagcctggtccccagcggctgcgccagcctagctgtgttcaccttggggccgcgagggcctcccaccggctggcagctggtggacacgctgtcaagatcgggggaaaaaaaggaaggaaggaggctagggggacacagggctggtggcctccgcagtctttgacctgcgacgggcgcgagcgcacctccgcgcctttgcgcagagaccttcccccaagattggctcacgacgcctcctaccccgaagtcaagggctccctgtggcaaatcctcacacgccctcctcctccccgcccatccccggcgccaggactgacggggagagggcaaggccgggccagaggggctgtgggcctggactgcggctgtcgcccgcggccctgctcttttgggcagccagacgtggggtcagcgcccagtcgcagcctccgggggtgagtccgcagatccccgcacgtgacacaggccaggcatggggacggggagttcctcgtcgtccgttcccactcagatgctccctgaggttccggaacaccccgccccccatcccaggatctgaccaaccctcaagccacggccggccccggttccgcgagacgggggactctgaggattgtcctcccttccgggctgggactcccccacagcagccgaccgcccccagttcagagtggcccggcccgcagcgctccccgggcacaggtcccaggtggacggctccgctcccgcgcccggctcctctgcccgccaagcgccccggggattccccggcctccaagcggccgcggccgggtggagtcagccccgaagcccgggatcccccgaagggagaaaacccgctctgctcctctgaagcggcgggagaaaccggccccacccaggtccgggggcccgacgccctcggcggaggccggctccaggggtccgaggttcccgaagctggaggccggctccgccccggcgtccccccgccgccacctccgcccccatcccgcgggccggcggagggaggggcggggccgcttgccgcccgcgactcgggttcggcttctttagtgattgcttctgcttctcccgcgccagctgtccccagctctggggcaacgctgccaggtgcccagtccccgcgctcgagagagcgcctgcctggctctgaactctggccaggaaggggcgcgaggggaaggccccgggggaaggcgtgtccccgcgccccgccccgccccgcctcggaaagcccccgcggtcccgcccaccccaggggctcgctcagcctccggagacttttttctttgagcgcagccgcctggtgccggtttccgccgagctggagcgcgcgggccacggcttctctggggacgcagaagcgagaagcggggacctcggcgcgcgccccgcgtcccgctcttcctgcccgcgccccggcccccggcccgcgccccggccgccggcatggtgctgctggccgggaccgggccggagggcggcggggcgcgctgcatgaccccaccaccgccgtccccaccccggggcgcgcaggtcgaggaggaccccgctgactacgaagagtttgaggacttctcgagtctgccagacacccgcagcatcgcctcggacgactctttctaccctttcgaggacgaggaggagcacggcgtcgagagcgcggagagcgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcagggtaagcgggcgtccccgcaggatttgagccccctcactgcccccactcccctcctccccaccacatccccgcgcctcccagctcctggctccggaccggtccctcggtcactcagccgccgcccagagcgccttttccccgctgtttgggagcgcggtgccctgggtggcttccccgtctcaggctgggggacgcggtgcggggagggagcagtcgaggtgtcagcgcggcagaaacgccagtccggcgtcctcaccgcatccccttctcgtttaccggtccccgtggacctcctgactgaattcgcgctggctgcccgtgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagagtcagggcatagggagagccccagagccgcgggcatccacccgggtagggcaggaggcgtggaggcaggcacaggctatcctttcgttatgaccagattcagagaaaacgagatgtttagaaaagaaaagaaaagaaaggaaaagaaaaaaagttggcttaagaagacctgagaaggactggctggtggaacaccttccaccaagcaaagcacttcaagggaaaactgcagagtgaccacggtggccaagttccccgtagtctgtgctcagtgggcaaatggcagcgttctcacctgatttttgtattgtccaaggaccgtggtatctgcagatgcagcctagcacaaatgcacatgctttttgctcaggagcctgcagctgacagaaaacatgtgctttgacttggggacccgggtgaccttgtgcctttggtttatcctgcagtgggtggggcaagtggtttgccctgactgtggtttgggctgggcttaggtggatgggaagccctccaatgtcactctccccttgtactacattgcccccgtgattcaattacctcccaccgtgtccctcccacaacacgtgggaattcaagatgagatttgggtggggacacagccaaaccatatcacacaacatttgaacttggaggaagggtctgtgcttgtcatatgttaggcagtgagacctgaggtggcgtccccgtaggtagcatcacctggagccctgtagttcctgctgccattcctcttgcaatgcctcctcccccagccctggcgacagatgccctggctggcatgtgattagggcttggagctccacccgaagtcctagggcctgtttctcaagttctacatttggtttaactgagttttcaggcccagatgtgtgtaatcagaaaccttgctttctggaagccagtatgggggcccgctttaaaggaagcctcaccaagctcataaaggaacaggtggggtgggcctctccccctgtcctgggcagcctggtggtctccagtgggctggaatgggcacaggaggggcctggctcgcccagtccccactctagggcaccactgggctcagctttatataatgtttcctttaggggcaaaacataaatgtttgaaaacagctgcattgaagaaaactgacagcaacgtaaaccatccccaggggctcgagcctaacagactgagtctccaggccacacagcagagaggcaggggagggccgtggtatgggaggctagctccagcctcccagcagctctctgcctcagtttcctcgtctgtaaaatagggataagggcagcctctcctcttaggatgtgagcataaaatggcttagtgcccacaaggctctgggaaggcctggccccaggcttgtgtttaccatcgtgtttctcattcgtctgccttctcttggcttggaagagagcaccttccagttttattttgttttgttttgttttttgtcttctgccaggcaaggctttttctctcgctgcttttcttcccctttgattacagcagaagtgaagactttgtttctctgtgtcacgtaaaataatgatgtaggcccggacatagcctgctaacttagagacccttggactctttcatctttggatcagacggagcagggcttgtgttctgtgctttgtgaggccagtggggggagcgaggcaggagcctccattcttttcattagcttctcaaggctgttgatcaaacagcctctatcttcctgaaaaacagctgaaagaatcaagtgtggcaaagccctgatgccctgctctgtggtaaatggagtgagtcattgccaaagtgtttaccgcagacctactgtgctcccgctaggtactttagcagactcaaaactgaatctggcagtccctgcctttgaagagtcctagccttttagtgaggagaagaacttgcagaggaagagcggctagctgagacctaggaaactgggagacggactgcttttcacatgacggtgtccggtctccccgacggcagtgtgggtcactccctctctgtctgcaggctcctggtttaagggcaccttccctgggaggcttttctgtctcctcttgtccaagcctacagaacctggagctgagcaagggtaatgtaggcattcacacatttagggctgaaattataaataggatggtcatttagagagcaggtgacgtttgagcagagacggcatctaggggaaagaggagttagacggagggaacagtgtgtgcaaagactgaggtgggaacctcgttggagcctggtctccaagcttatcatgattagtggcagtgaaaaccttaaagaaggcccggacagctttggtgcagtggaggggtaattgcattaatgacagaatgacagctcacagatacagcccacagccggctttctaggaggaaatgatctctaaaggcgtctaaacttttctgggacatgcttgttgagctcttcatctctgggcatttaagaagggagctttgcctgagctgacaggcattccatttggtctgggtaactaagggtcagatgtgttttgtttaagaaaatgcattctctcctgcctcctgagattggtagaatgttggatgtggctcagcacaccattttccttctaaaatatttattgctctaaaagcattgcatgatttaatatgcaacatgtaaatatttgtcagataattgcccaataacattcaaagcttgcttccaatgtcttctggatttatggttgttttgttccttctgacttgaggcagtgcaagctgccataattctttttcttaattcttctcttccacttactatcacctgaagttcacctttatggccttggcggctcttgagatgacagtgaaaacacacaaagtgtgttgttttaattgttgcagaagggcagtttaaatgtcagacagctcttggacttaattaggcccaaatacatgctcaatttaaaatactgcactcctgtcctgatgggattctgcttctgcgtgttcgtgtttgtttttgagactgagtcttgctctgtcactcaggctggagtgcagtggcgcaatctctgctcactgcaacctccgcctccggggttcaagtgaatctcctgcctcagcttcccacatacctgggattacaggcgtgcgccaccacgcccggctaatttttgtatttttagtagagacagggtttcatcatgatggccaggctggtgttgaactcctgacctcaagtgatcctcttgcttggcctctgaaagttctgggattaccggtgtgaggcaccgcgcctgccctgcttctgcgtgtttaaatttccagggtctcttggttacgttttccaaaggcccctccattggtttgttttgttaggtcagcaaagcccacatcacacccagtgtgggtgtttccctttactcttgaggtgcttaaaattaaaacttaattttcatagatttatagcgatgatcagggctttatcttgaaatgtatgtgagaaagtttttatttatttatttttttaatacttccgaaagatttataagctccagaatcacttttccccaaaaatgagaatccagttattgcaacagccctccgtctttaccaggcctcggtgctcatggcctgcgtgtgcacagcaacgggctgactagcatagaaagtgacttctctggttcttgttagttaccatagaaagtgaattctggcctcaggcctctgtatgcttgcggagggcctgcaagcacaagctttgctttttaggaatgtatgttaggctgggcgtggtggctccttcctgtaatcccagcactttgggaggccgaggcaggcagatcacttgagcctaggagtttgagaacagcctgggcaacatggtgaaagcccatctctaaaaaaataccaaaattaggcaggcatggtggtggacgcctgtagtcccagctactggggaggctgaggcaggagactcgcttgagcccaggaggtggaggttgcagtgagttgagattgcaccactgcgccccaggctgggcgacagaacaagacccgtgtttgaaaataaataaataaataaataaataaatagaggcatgtatgctagtgttttagttgcatctccaaattctgaactgtgagaaagcgggtgaggagggcaaattgagcagaatcctagaccgggagtccgaggggctggagtcagaggaggtctcagctgaaatgggcttggcgatgggtgggctggcagatgtctgcctcttcctcttctgctgaccgtggtggggagcattctgagtctagcagcagtagagaggcccatgtgttttttgtttgtttgtttttgtttttttgtttagagatggagtctcgctctgtcacccagtctagagtgcagtggtgtgatatcagctcactgcaacctccgtctcccaggttcaagcgattctcccgactcagcctcctgagtagctgggattacaggcatgtgccaccatgcccgactaatttttatgtttttagtagagacggggttgcgccatgttggccaggctggtctcgaactcctgagctcaagtgatccacccacctcggcctcccaaagtgctgggattacaggcatgagccactgcacccagcccccatgtgtttttgatataagaatgtcagtcatctgtggccacaatcatgctgcctaccaaatagctacaaaaccttacaggtgtttacaactgtaaatgttttgttgggggtggcctatctcagctgatgtaggctggatttgctcattcgtcttcattcagctggtggtcagctgcgaatggcaagaccaaaacagtcttaactgggaggactcatcgctgctccatttggtctctcatccttcagcaggctgtctcggcctgttttccatggcaggggcagggttccaggagagcaggctgagcaaatatggcctcatgatgcttcagcttggctgaagcatcacttctggctgctttgtcacgtattgcttctttattttattttatattattttgagatagagtctcactctgttgcccaggctggagtacagtggcataatcctagctcactgagccttgacctcctgggcacaaatgaacctcccacctcagccttctgagtagctgggactataggtgcacacctccacgccaggctaatttttatttattttttgtagagacaggatcttgctatgttgcccaggctggtctcaaactcctggcatcaagcagtcctcctgcctcagcctcccaaggtgctgggattataggcatgagctaccatgcctggcctcctttattcttttcagattctttaacaacatgactcaaataaccttttttttttttttttttgtcaattaggactcattaaagaagagaaaacaggcatttagtttttaaaaaaattccttggtataagtgtgtttgtgtttataacattgtaattattattattattggtcagctgccaacctgaaaacaaacaacaggtagaataatctacttcaagcctgtacttacagtgctaatttcccccatagtctgtgactttgcccctgatctacagtgtgaaatggagagagggctctgctgcgtttgggtttcttgagtacttattttaaaatcttatttgtttatttatttatttttttgagatggatctcgctctgttgcccaggctggagtgcagtggtgcgatctcggcccactgcaacctccacctcccgggttcaagcgattgtcctgcctcagcctcctgagtagctgggactacaggcatgcgtcacgatgcccagctaaattttgaattttgagtagagatggagtttcgccatgttggccaggctggtctcaaactcctgacctcaggtgattcacccacctcagcctcccaaagcgctgggattacaggcctgtgccaccgcccctggcctcttgagtatttatttgagccaacaggtgtccacactggggcttgtgcctggaacccagagtgtgcttttcatttcctagtcctgatctccagctctgatttttttagattgaggaaatatccatcacctcaaggggttaatagttttctgaaataaatttaaaaaacaaaatttggataaatttaaacaacaatgacaaagttgaaaaaaatgtgagtccagatttctgaggtgtttgcaccaggtagtctcccagagatggtggttcccagcttggactgtacattagaatcatctggaaaggtctataaaagtccaagtgcccaggccacatctcagaattaagtgagaatctgagggtaagataaggcatccgtattttcttttttctttttttttttttgagacggagttttgctcttattgcccaggccggagtgcagtggcgcaatctcggctcactgcaacctctgcctcccaggttcaagcaattctcctgcttcagcctcccaagtagccgggattacaggcacccgccaccatgtctggctaatttttgtatttttagtagagatggggttttaccatgttggccaggctggtctcgaactcctgacctcaggtgatctgcccacctcggcctcccaaagtgttgggattacaggcgtgagccaccacacccggccagggcatcagtattttctaaaactcccagagtcatttcaatgtgcagccaacactgacaatcactggtgcagactcttgaactcaaagtggggtcctgagacctggagcagggggttccctgctggggaacttgttaggagtgcagaatcccagccctccccaccaagacctgctgagtcagggcctacttttcaacaaaacctgccaggggctttggaggcaatggagcctttgagaagccttagcacagagcatctcattctaccctcggagccctgtgatgtggatgtgggtgtctgtgatgaatggatgaagttacaggttcagggaggtgccataggtgctcccgtggtggagccaggaggcagttccggtgtggtctgagtctgaaacttaccatccccacaacacatggcttcacctactgcccatgccgcagcgttagtgtcaggcagccccgtctgggcctgttccccaagtggacactggaatgtgacttctgtctttccttgtctcagaaaaagtgtgccactatgaatgcacttaacacccttcactgggcacctctgctgagcacaggctgacgtggttacacctgcttcttcctgggcctccctgtccatgcctctcccagctggaatgtcccttgccagaagtgtgggtcctaattcaagggccaggtaagcatcccagaaacagaggccagagagaaatgcttcattcttcattcccatctgatcagatgcctacttctgatctgagtttcatcagacctgacataaatatgcctctggaagcatacgtcgttatttctctgtttctttgaaattgctctcaaatcccaccactccaatccaatcagttgccactgagccagctgtgacatgggatttcacttctacctcaatttctgtatctctgacttagtagaaataagtaaaatccaccttcaactgtcctttaaattcagggacatcatttaaaaataatctcttccagctgggcgcggtggctcacacctgtaatcccagcactttgggaggccgaggtgggcagataacgaggtcaggaaatggagaccatcctggctaacacggtgaaaccccgtctttactaaaaatacaaaaaattagctcggtgtagtggcacacacctgtagtcccaactactcgggaagctgaggcaggagaatcacttaaacctcggaggcgggggttgcagtgagctgagatcacgccactgcactccagcctgggcaacagagcgagactccgtctcaaaaaaaaaaaaaaaaaaacctcttccaattcttttatggacatacatactgtattagtctgttttcatactgctgtaaagaaataaagaactgcctgggactgggtaatttataagaaaagaggtttaattgactcacagttccacatggctggggaggccccaggaaacttacaatcatggcaaaaggcaaaggggaagcaaggcatgtcttactacatggcggcatgagagagtgagagtgaggggggaagtgccacattaaaaccatcagatcttgtgagaactcactatcatgagaacagcaagggggaatctgcccccatgatccagtcacctcccaccaggcccctcctctgacatgtgggaattacaatttgagatgcgatttgtgtggggacacagggaaaccatatcacatacttaatgacatcaaggactcctgacaccctactttatcttaaactctgacatcatcagatctacaaacaggtaacaccatcatacccctccactccccatcacaaataaaaggggcctcctctcagtcatgctcttcacgtctgtgtggctgccatcaaccccttccttgccccgggctcttttacacacgcacaaacatgcgtgagcaggcgtgtacacacacacatacacacatatcattccaccggctgtgtagaagatatccaccttttgtgaatgaaacatattttctattttctttgttcacatattttagtaacttttctacatatttctttcaattaaaaggatttatgtattcttttacatatggaattatcttgacttaatttggagaaaaatttcacatggttatgatttagaattattagcccagtaggctgtaaagccaagctcaagaaaattcaaaaaaatggtgtcataaacaccatgttctctgaatttggttaattttttttttctagatctaacacaattctaaataactcctagataaaatgggaaaccataatgtaaattgagctgaaaagtaataaaaatattacatatcaaaatttgtggggaaaagcaaaagtggtatcttgaaggaaaattacaggtagcataaaactaaaggaaagaaataatcaaatgaaaagcagaaattgatgaaatcatgaagattatagatccaggacaaaagctgattctctgaaagtaataataaaatagatatttttgacagtagctgtcatcaaaaagagaaatagcacacatttgaaaatacaggataacaggttatagcacagttaaaacaaagattaaaaagagatcctgtaagaatgtcatcctattaaactttaaaactggccagctgcagtggctcacacctgtaatcccagcactttgggaggctgaagcgggagagctgcttaaggccaggtgctcaagaccagcgtgggcaacatagcaagactttgtctctacaaaaaaaaaaaaaattaaaacttagtcgggtgtggtggcacatgcctgttgtcttagctactgggaaggctgaggtgggaggatcacttgagcccaggaattcaaggctgcaggatgagctaggatggtgccactgcactcagcctggatgacacaatgaaaccctgtttccaagaaacaaacaaacaaacaaacaaacaattctcacttaagagtcttgctggcaggctgggcgcggtggctcacacctgtaatgccagcactttgggaggccgaggtgggcggatcatgaggtcaaaagatcaagaccgtcctggccaacatggtgaaaccccatctctactgaaaatacaaaaattagctgggcgtggtggtgcacgcttggaatcccagctactcgggaggctgaggcaggggcagaattgcttgaaccagggaggcggaggttgcagtgagccgagatcgcaccactccactcgagcctggcaacagagcgagactgtctcaaaaaaaaaaaaaaaagagtcttaattctatgccattgttgggccttacctttatgaataagtaaacagggcctggcaaacggaaccagttttctgtcctttagagctagagctaagggtaaatatgacgggcagagtcccctatttaagttggagagctttctgtaggttcccagagcatggctaacaccatctccagagaccttctgctgcacattcaagcacttctaggccactctgcttcccttcacagggacaccgacttacccttgctgatttaaaaataaaggaaggccagggaattacagggagtgaaaagagttggtctcagaaggttatatgctgtatgcttccattgacgtcacagtcttgaaataatgccgttgtggagatggagaactgatcagaggctgctggggccgagcgtggggaggggagaagtgttaccataaaggggtagctggagggggcctttcagtgctggaacctttttgtgccttgatggtggtggttacaggaagctacgtgggggttaaaattgtatagatggacgtatacacacacacacacacacacgattgtgtgcatacaggtgcaatctgaataagctgcatggattccagcaatgtcaagttcgtggcattgttattgtacagtaattgtggaagatgctacctttggggaggacaggtgaagggtacaagttcttgtggggctgtaactatttcaaaataaaaagttgaatgagcgtgaaaagctgcacgcatgacctttttcctgtagccttgtttccatgaatcgattgaattttggacatgaaagcagggtcagacctagttattaataggtgggaagaggactcactggaaatattgggcaacagaacctggctgccttcactgtggttcatgggccagcagcgttggcatcgcctgggagcttctaccaaatgcaggatctcaggcccctgagaatctgcatttcaaggtcctgagatgatttgcacatacatttaagtttcaggagttctagaacttttcttagagtagaaatccagtttgttggttgcatgatcctggacaagtcccatgatcttttgatctttagtttcctttagatacccatctagaaactgggaggcttactatgaagataataacacctcctagaggttctaggcagaactaacgagtaagttacagagaatgtgcttgtgctgtaatagacactcagtaaacagagctgttgtttctatgggcgaatgaatctccagatggttttccagtactgctagttccattttagccaaggggaaaagtggaagcaaattgaatgtttaaccaaaagaagagtagttaagaaaatagcacatccacatggtgaggcctcttttgtaactgttaaaagtggcagccagtgccatggggagaagcccagaagagagcagaggagggtgctggggcttctggtgcatcctgtgggcacctcggatgacgcgagggtggagcctgaaacgctggcccaggaaatggaacagaagcctgttgtgggtgggaggagaatcggaagcggcataaggagagtttttcaagaagggggaggaagctggtgccggggatggtcacaagcctttcctctttcttttcccttccctttcccctttccctttcccttccccttcccctttcccttccccttccccttccccttttcttttcttctttgagatggagtttcactcttgttgcccagtctggagtgcaatggcacaatctcagctcactgcaacctttgcctcccgggctcaagcagttctcctgcctcagcctcccaagtagctgggattacaggcacccaccaccatgcctggctaattttggtattttcagtagagacagggtttcaccatgttggtcaggcatgtctcgaactcctgacctcaagtgatccaccagcctcagcctcccgtagattacaggcgtgagccaccgcgcccggccgcctttctcttttcttcagcaccagttactgcaaagacccctggagtcggggcccatcctgggtcttgcagggactgattctgtccggtgtcgggctatgcacaggcagctgtggtggattcctgggttctccccacatctgcttccctttaacatgtcaaggcagccatccaaagggcatgaccctttccatgtgtagcgggagggtcagtctgtatcgcttccttctagaccttgcagcttttgtattttaaaactcgagagacaatagtcatctcctaaaaatagcagcagtgacatagctccgcagtcagttttgctggcactgggaattcagcttttgtctctggtgttagataacgggcaggtttctaggaaatgaattccatgtacagtagagccaggttcagttgacctcactggagaccttgaacccagcttgctgcaccgtggggtcctttaatcatctccctgctgacctccatgctttggagggtccaggtcttagggggacctgtttccttgggagtacaaaggccctagacacttaagagtcgcgtttcaggaagctggcacagcctgtgaggggccttcaggagtggggaaaggggcagtgccttgtcacctatatgtcctctgttgaagagtgaactgcaccaggccatctctgaggctctttcacacactgtgatgggtggaaggccactttcagctgcaagtacagaccctgtagatgatcagctcattctagtttgcctgggactttccggttttttgtttttagcactgaaaatcctgtatcctgggaaacccctctgtccccaggaaactgggatggttagtcaacctgcctatgtacaaggccacccttaggttgaggctgcacacagagtgctgcctaagagaagctgaaggacccaccaacagcagaatttctcctttagcactatctggcccctgactttggaggaaagcagcatgttaagttacattatctggaaggaagcactggactaaacttagtcccttatactggattcttttatcacacaagaaagccatcacccagccaagggcaggacccgcatggggacacaggacagatagatcttcttggggggattttgggagataggacagcccttgatcagagagggcccatggggtggagggtggggctggattggagttggggaaatgtagattaaatacatttcttgaaaaaaattcagttaagatatgctagagaagctacggtcaatttctttttaatagaaataatcatttttaaattttatcaagtgtaaacaaatctgaaccgttgggtttgtttatgaggcacaagtatattgagttaattttgaaaaaccccaaacctatctcattttttagagatagtgacttacagtgactctactaataattttattgggtctaagaatacttaagatactcttggctgggcgcagtggctcatgcctataatcccccagcgcttggaggggctgaggtgggtggattgcctgagcccaggagttcaataccagcctgggcaacatggcgaaaccccatctctacaaaaaatacaaaagttttctggtcatggtggcatgcacctgtaatcccaaccacacaggaggctgaggttggagaatcatctgagcccaggaagtcaaggctgcagtgagccgtgatcgcgccactgcactctagtctgggcaagggaagtgatactgtgtctcaaaaaaaaaaaaaaaaagatactctctccttttttttttaattccccagttttaatctggtagagggaccttgaaaatacttaaatactcatatcattcttatggattggtttgggtgtgtgagttctaacatagacaggaaggctatttttcctatcaataacatccaagaagcctgctaagtaatggtttttttttttttggaaaaaccatttggaaaagaatagattttcctgaactttattaaaacacaaatcaggtgctgaagggataattttgaaattctgtattttgaatgtctttccacttgcagaagaggtatgtagtttttaaaatttctgaatagaactacttgtgcatgactttgaaaaagtcactttcactcaaaaaataccaggttctttacctggaaaattaatcagtgcacatatagatgatctctagctctaaaaattgatgggattctatcttatgatttaaaaaattaaatgagtagtattaaatgattaaaataagtagtcacgggatgactaggaacagaattttttttttttaaagaaacctagtgagaaaggtcaaagtaatgggaaatccccaaaaagcatagtaaaaggaagcaatttgaaagtgaagaaaaaggaaccttttaaataacagctgtattgatacagaattcacataccatacaatttaaccgtttaatgtctaccgtggtttttatcatgttcacagatttgtacaattatccccacagttaatttcagaacattttcatcaattcagaaagaaccacataccttttagcttttaccctctattccccaccccctccagccctaagcaaccattaatctactctgtctgcctgtttacatgatttatgggaggatttttatgaaagaaccagatccctgtaattttatgtccccctatcttgacattttcctcagtaagagagtaggacaatcactccaccaccaggagtggctgccacatgcaagacatatgtgggttctacctgcaagggtctcaccataaattacctgtcaattacagtggaggatgaggggctgagtcttttaaagtatgcagagccctaagtctgactcattctgtgttgagcgttgggccacactgtctgctcattcatctctagttggtttgctgacctgtcgctgcagaggtcctccgagtgtggtccccacccagcctcacttgggacctcaccctagaccccttgctggggcagcagggtcagcactcagtattgagcaaaccctccagcggattatgttgcctgctcgagtttgagcaccatggatgtttcttgtcccccacccccagccccaccctgccacccttcaggttttctctaccctgctttcttttctgaagagaaggttgcagttggtttctctggatcttgtctgttctctctcactcttttctttcttttcttggtcctgcctccggtttggggtgggggcagctctgtggagagtaggccagttggctttgcctttggtggggtgtcgggggtgaggcttgggagggactcgggagtggagagatgttgacagaaatctgcttttgccagtggctttggtccggacttgcccctggaccaggtcttttcagtggcctcctcccactgcctcttccatccttccctctcttctggttctttccctccttttcatgaacatatttagatccctcctgtcattaaaaacaaaaccaacccaacactccaaactcacttggcagtgggttgggctctggcaggtcctctaagtcttctgcttcccaaggccaaagggctgccagtcggtgggtcccatgtcctcgtcctgcctccagccttggggtgggctggttctgcccttgccagcccagggcttctgccttctcaggctgcttctctgcagtgtgtattggctttattggtgggtgtcatgaaagcatctgtgcctggggcctggtcccaccccttaagtcctgatttcttccccatcccagccactgagacttctcatgaccttggcagggctgcctcctcctcccccagtgttttgggcactattgtcagaattggaacatgatgacaaacctgctttggggactgggatgccagggcagagtctcagattcccttggccccctgcctttcagccaggtgtcctaggggagagcagcctgtttgaggtgcacggtggcctggccctctgggctcgccaacaccgtggctcctaggaactgctctgcgtctgggatcctctaccctggatccgggagcctctttttgctttttgcttctttacactgctcatttttggtctcccctggatggtctggtttcccttcctttgttccatgaggcacttttcataggctggcctctttactccctgtcatggttagttttatgagtcagctgggctaggccacagtacccaggtattcagtcaaacactggtctaggtgttcctgtgcaggtattttgtagctgtggttaacatctacaattagttgactttaagtcaaggagattaccctctataatttgggtggacctcatccaatcagttgaacaaaaactgaggtttcctggaggagaagaaattctgcctcaaagctgcagcctcaactcctgcctgagtttccagcctgcctgcctgccctgtagattttggacttgccagcccccacaatctcatgagccagtttcttaaaataaatctctttatgtctgtatctcctcttggttctgtctctctggagagccctgacttatgcattcccataggaacattgtctgctggcagagcctcctcaggctcacgcagctggtgccagctctcagccctggaccactttcctaagagtcatgtgtgcattcagcctcatgtgcagagttcctcttgccagtcttcccccagcatctccttcttaacgtattccttttgcctccagggccagcttcctgggtatacagcctgtccagttcacaggcctgtgcttaaaagggccctatgtctgatgtaacactctgctgttactgttttgaaattcttaatggttttgaaccagggcctgcattttcattttgtactggggctgcaaagtacggagctggtcctagctgtccctgcgtttctggctgcccgtgtttacaatcctagagtcagcccagccttcctcatctcctgtatccagtcatttcccaagcgggggggatgtccaccatgatggtctcccacatttcactggggtctcacttaagcaagtgctataaccccccgccctggagtctctcaccagtctgttctgctgccacttctagatttatcttcatgtatgtggcttttttattttctttttaacaacagcattgtctttggaaactctccctgcagggctcctcccaacagttctccagatgcttccctctgtgtcacagaagccaggtgacttgctgtcccccagctgtgcgctgtgctgcctgctccctgttccgccatggtggatccttgttccccatggaccacacacctgtccctcctttgactgcaaggccactcagagttcccctcccatggacttcccgtgggctcctttgccgcatggcttccccgactttggaccctcatcgcagttcgcaacttggtatagatgcctttcattctgcgttgttttatattgattggtggatattttctcttgaagcttggtcagctccatgagggagatgctcaacctcattcagtttctgccctgtgcagtccggcagtttgtcgcacatggttggtggatgattgtccctgcttttttttttttttttcttgtttttgagatggaatcttgctctgtcgcccaggctggagtgcagtggggcaatctcggctaactgcaacctccacctccagggttcaagtaactctcctgcctcagcctcccgagtagctgggactacaggtgtatgctaccacgcctgggtaatttttttgtattgttagtagagacaggttttccccatgttggccaggctggtcttgaactcctgacctcaggtgatcctccctccccgggcctcccaaagtgctgggattacaggcgcgagccaccgcgcccgacctgtccctgctttttgaacatgattcaagtatcgtgccctgttgccagttacatatactattttgaaaattcttaaaaataggataggtctcagcactgtggacattttggttctaataatcctttgctgtgggaacccgtcctgtgcatggcaaggtgctgagtagcatccctggcccctgcccactggatgccagcaccagtgccttcccctctgtgacaatgaaagtctccagacattgccagtttctcctgttgaagtcactggaatagggatagagactgaagggagtaagattgttggagttgtgaacctgagtgccttcttacctggaaggatctgtggtatttggcacgcctcgctgctctctcctgcctcttcctcaccaagagttttgtcaggtgttttttacagttaaagaatttatgtactttggtaggaaaattgtgtttaccagcccttccaacaggcggtcctattctgtaagatggaaaatacctataattagaattcctggctctgtaaatgcttctctctttgtgatttggagtgtttgttgttgtttgaatcttaacatttgactgtatttttctcttggagttgtaataagacaagggagcttttaaaagtgtaatctgaggagattaaccccaggaggcatgaaatatccctccgaagatcacagtcggtctttcgaggacatcctgccacgtttacccagtgcccggcgtgagcagcctagaagacgagtggtggcagctgccacctgcccggtgaaaatgtaattgacaggaaattaatgaggggccagagatgactgttttatgcctaacagaaccacatgacacgtgttttaccaagaaatcatacatttggctttgattttcaaagtgatttttatgaactaataacacttcaagcaggcactttctctgttggaattctccctttaaaaagaactgtcagctgggggcggtggcttatgcgtgtaatcccagaacttcgggaggctgaagtgggctgatcacttgagcttgggagttcaagaccagtctgggcaacatagtaagaccctgtctctacaaaaaatgcaaaaattagccagatgtgggggtacatgcctatagtcctagctactttggaggctgaggcaggaggatcacttgagctggaaagttgaagctgcagtgagccatgatcatgccactgcattccagcctgggagacagagcaagaccctgtctcaaaaaaataataaaaaaaaaagaaatgtcacaaaacaatttgcattaaataagcctcttgattcagcatgaagttgcctctttttcagtttaatgtatttatttatttagcaaatatttattggacaggggtacctgtgccaggcgctgttctaggggacagaatgccagacagaaatggagattgctgctgaagtggagcttacgtgattttgggggtgagaaacaataacaagctcaaatacatgcacctcttctcaggagggagcaagtgctcaggagatgggataaggtaggcagggaaagggttttgcagcactgggctggtgctgaaaatttccgtcctcgttgaggaaggaacctttgagtaaagacctggaaggaagtgaaagtcttgctgtttggaggtctaggaaagagccttccaggctggtggagcaggtggtagagctggaatgttctagaagagccagaggtcagagggactacagcagagcaccatggggagagggcaggagatgaggtcagaagtgaccagtgctttactcacaaagggaaggacagacttgggtaaggagagctggaggggaaggaagaagacccaactccagtggtaagtgagagctctgctggcgtcgtgttgaagtttggtcctctttgaagtggacacagtcttccagggcagatcttcttaggctctggttgtggtgagctcgtctcttacattgtgcttacttagatcaatgccttttcagtgtttgtttaaatcaacaagtgttttcctggatgcctacagagctggaacctgaggtcccctaaacattgtccttgatggacaaatccatatttgggatgctgatctgtggtccttaacttagacgtcttaggtctgacttcgagtctccacagtcatttccatttgacaaagggagtttaagcatgtgattagatggggtctgtggagcatgtggctttgcttgttctagggaaaagaaacgcactgagaaacacctggaattagaaagcacttcctgggtgtttgtggcttcctctgtcagccctggagatgtggctgcccaaaggcctgtgtggctaacaggtgtgctggagatgtctggattgtagccttgctgggagccctcatgaaagacaatgcccgggcccaggtgtttgatgggttaccatgctgggtgagggcgctgtgccaatggcataaagcatggggtcatggggtcatggcctcatggccatggggtcatgcgtaaagcagagctgtgggtccagggtctgacagatgggactcactgcagggcccctcctctctgtcctcacctgaagcagttgcatccatcagtccttcgcccatcccagagttttggtgatggcttccctgtgccaggctttccgcaggagactggaggccaagacaagtacaagccacggggctctatcatcaaggacccaacaggcagcaacataggctgtggtgaagaccctgaattctatgttcttgtgggtcttgggagtttctctgttgtctctgctccatgctaattgcatagcatttctttcttccattatgtaacaccgagaaatacagtcatccttcaggacacgtgaggaatttgttccaggactcccccacctatacccaaatctgcatatactcaagtcccacaatccgctttgtggagcccctgtatacagagtcagccctctgtaggtggatttcacttcccacgatttggttgaaaaaaatctacctataagtgtactctgacagttcaagagttgtttaaggttcaactgtaacacagccctatatgaagaagaaagaaaaggctggtgttggtgccacagccagtggctctctacttgattggaagttcttgtttagacctgatacactgtgagaatacgatgtgcgttgggttcttgtaactgtgtgtgtgtgtgtgtgtgtgtgtgtgtgtgtgtgtgtgtgtgtgtgtatactgctttcttctctttattttccatacagtttataagaggacattcagaccaacaaacagttctcatcttcagtcttttagtgctgaataagttttgctgtgtggcatcttaatgcgcaatttaggaaattgctcttggtatcttgcagtcacagccagattcaattggtgagggatctttccagtgcaaacatggccttttccaatacatttacatattctgggacattactcatttgtttcctggcttttaacagcactgcaaatatgggccttttctgaaacatttacatagaccaggacattattattcatgtgttgcctggcttttaaatcaacagcagtatttacttagctaagaaattgggagactctttagcctactgaatttaaaaaagcagtgaagtgttgggggtatgtgaagttttcattgtgggagagtgtttccaattttagtgattttatttattatttatttatttatttatttattttgagatggagtctcgctctgtcgcccaagctggaatgcagttgtgcgatcttggctcactgcaacctctgtctcctgggttcaagcaattctcccacctcagcctcccaagtagctgggattacagacgcccgccaccatgcccggctgatttttgtatttttagtagagatggggtttcaccatgttggccaggttgatctcgaactcctgacctgaagtgatctgcctggctaatttttgtatttttagtaatgacggggtttcaccatgttggccagacatgtcttgaactcctgacctcaagtgatccgcctgcttcagcttcccaaagtgctgggattacagatgtgaaccaccacacccggccagattttagtgatgttaaagatctttctgagtagagttactttattttcactgtgaatgatcacattcacaacatgatccttattcttttactcggacaacattgaatagtaatatttattaggtattttattattcttctgatacaatttttttttttttggtgtggaaaatgaaaaaaaaaagagaagtacaaagaaaaaaacaaaaaccagtcacctgtattcccagtacctggagctaatgatagtgaatttttcggtgttcttttctgacttgtgctgtgaaatatatatgctctgccagattagctatctgtaaagttatctatctataaataaagttttgagtcctggtttattcacttgtaggggtatttctatattagaaatacttcagaatcttgattttaaaaatccaacttctgcatatatcatagtttattcagtaattttgggtcttttttgtttctgaaattttttgtgatataaataatgctctgatgtatgaatgtctaaatacgtctcttattggctctctgggcagttctgtttagatcaattccaagaaggtatattattggtatgttattattgtacccagttttccttccaccaacagggtatgaaattgcctgtttcactatatcctcatgacactgaatgttaattatcaaaaatgttgaaacggctttgctgatcttcaaaatattaagtcatgcatacttattgtaaaatattcagataacataaaaaggtaaaatgccaaagatgataaaaaagtgactgcgaattcatgatctaggcatacttatgtatttgaggtataactttagcgacatttaatataatacggtacttataatcttttttccttagcaccttcatgagggcacctttctttgccagcaaatacatgtcgtttttaatgaccacaatgtactctttctggatatgttcgtttctttaacctgtggcttcctagtggacattgaggttatttctggtttgcagattagtaacaacacagagatttgcacatctttgtacagaaacctactgactctcttaggaaattgttagattttgtttcgatctgtggagtaagttctcttatttttgaaagtaaatgtgcctttccctaaggtaggattagactttcctccccataacatcacacttggccatgtcacttgctctggccaattcagtgagaagtgacttgtgtaacttttggccagaagttttaaaatccagcgtatgatttgccatatcctttttcccctcttccgggcaacccacaattttccaggtagagttttctccatcagcctgagtcttgcaagggaaaacaatgtggaaaaaagctgcatgccaaccatgtggcatgagcaggaagcagacgtttgtcgtatgccattgggatgtggagattgcttgttctgctgcacagtctaactcagcctgagtgcatattagctagtggctccctagagagagtgaacttgcttattgtcatcacttatgcatatgaatactgcctcagcgtccatctgcttgtcctgttcccagcttgtcatgcttgactaacatattttgaggcagtcttcacgcagctcctgttttcatgttctgggtagataagaccccataccctgagctgcttgaccacattacttctgctttaagcctcgggaacctgataaggtaacccccgagttcctgtgctgagtctcgtgcttccttcaaatgaactaatccaaccgtgctgtgggaaacccacctaggtaaccccataaaggatccaacccacaggcccctccgtttctcgttccccacctgctggtcgaaggagcaggtcctggatggctcctcccctcttctctttggtcttgccaggggtgctgtcctcttccttccagacctgtgagtagtaaacttgattcattttgcagtctgagtgtccctcactgtgctgcacctgactacaccaagcctcaccatctcacttaacattacaacactgaagctttctagcaaggtaagggagtacatttccttctacactttgccaacaccaattaatttgactctgtttactcttttccaacttgtcaaaaaatgacacctcacttttatttgtgcatttttgttgattagtgaggctgagacatatttcatatcacatgtttactagccctttgtatttctttctttgaactaatttaccaattcctttgtcaattttttgattagtctgtcttatcttcttgaggtctaaggatttttttacatatgctaaagttattatattctgccttctttttctaatttgtcatttaaaaaatcttgtttggggtttatagagtttcctgaatatgcggcttgatatctcttgtcagttttggaaaattctctgccattatcttgtcaaatattgtttttgttccaatccctttttcttcctatcctgtgacaccaaattcacacacattagaccttttataccatgctgcctgtgtatgttatgcttttcttcctatcttttaaatcttttttttttttaattttctgggcatttttgattaaacttatcttttgattcactaatcatatctttaccctaatctactatttaattgctttttacattcttaatttcaattatgctgtatttctaaaatttttgattctttattgattctagttctgtaataaagttcctcatttgtcattatttgcttttacatattagttattttaaagcttgatcgttctaatttctggatcttctggggatgttttctattttctgtttttctcttggccctgtctcctgatacatctggtaatttttggaatgctagacattgtgtatgaaaattgaagtagcactagattgtgttatcttgtccagggaggatttagtttgcttctggcagacagagtgggacagaagattgcagtctaggttgtagtttttataagatctggcctctttctggcctgtcttgtaggatatagcccttttggcttcctatagaaatatggcctgggcagatcatgaataccacttttgtctccttaacccaagcttatccaacccctggcctgcgggccacatgaggcccaggatgactttgaatgcagcccaacacaaatttgtagactttcttaaaatattttgagatgcgcgcgcgcgcgcgcgcgtgtgtgtgtgtgtgtgtgttttcagccagtgttagtgttagtatattttatgtgtggcccaagacaattcttcttccattgaggtccagggaagccaaaagattggatacccctccctgcaaaccctcgagagtatgaccaactctgcttagctcctcctacccttcactactgctctctgcttggtttctcagcacccagccttactcagcaaatgcccttagggaaagccatgagaatggaagcttatctcaggatttccgccttctttctggaatacaatcaggcctgcaagtcctggtcgtcttggaaactggatgcctccaaatggatatttagggaaaaaaagtattcagttgttctcaggggaaaagtgcctctgattgaagccagtttctcagagctgaaagtgagagtccctgtcatttgcctttttactttctttacactgttttgctgagaaggtttaaatttttatacagtcagatgtatctatttctttatggtttccggccttgctctattgcttcaaaatgctgtttctaagccaggtttatagaaatagtcatctacattttttttagtggtttttttttttttttgagatggagtctcattcggttgcccaggctggagtgcagtggcaccatgtgggctccctgcaacctccccctcccagtttcaagcaattctcctgcctcagcctcctgagtagctgggacaacaggtgcgtgccaccatgcctggctaattttttttgtacttttggtagagacaggatttcaccatattggccaggctagtctcgaacgcctgacctcttgatctgccacccttggcctcccagagtgctgtcccgcaccgagcctttttagtgtttttatgattgaatatttaatgattcatttcagcctgagatgtgagataaagatccaaccttattttttttccgtatgactgggacttttgtccagaactattaatgaattcatcttttgtgaagatctgaaatgtaatatttattgttaagcatatggtgtctcattaatattttaatttacattattttgcttactagtaagattatgtatattttacatgtatttactggctttttgctattttttggtttttctactcattcctttacccttgaaaaattgtactcttggtgtatttatgctgatattcaatataatatttctgtttaaatcattctgtgaatgtcactaatcttgattgctttttcatttttctttcaattttacttataattttgatataagggaatattgtatttatatagtaacttacattgtatatttattgttatcttattatttttagcttttgaatctcttttctccatcagtaaactattttaggatataagtatgtatgtatgtatgtatatatattatacccttgactttttagtccttttgtattatcttttgattttatggtgtgtgtgtgtgtgtgtgtgtgtgtttactgctcagtaatcaacttttccagcaatgttggttgagtcatccatcactgcccagattgctcctttaacacatgttcccctttaaagacagggtcttattttgggccatctgctttattttcttctcaccaatttgtgggaaaactttattcttgttagtattctactttccttgtctcttatttttgttaaacagagcatatatgtgatagaaaatagaatcctggctgggcgcggtggcgcccatgcctgtaatcccagcactttgggaggccagggcgggcggatcacctgaggtcaggagtttaagactagcctggccaacatggtgaaaccccatctctactaaaaaaaaaaaaaaaaaaaaaaaaaaattaggtggacgtggtggcggctgtaatcccagctacttggaaggctgagcatgagaatcgcttgaacccgggaggtggaggttgcaatgagctgagctgagattgcaccactgcactccagcctgggcaacagagtgagactctgtcaaaaaaaaaaaaagaagaagaaaaagaaaagaaaatagaatcctgcagatgagcttgcagtgagagaccccaggcttcttggccacctgtctgctcctcagagctgtctcttgccactgttcccactttcatttcatctggcagtcccctccctgccagttgcaacctgctcatcatagctactcttggtttgtccatttgaggcagtggagatgattgtgtgcaatggtagtggagttttttgctgacttgcccttttcacccctctgatcagacccatccacccatcctttttcatatgtattcttttagtttcttatatatgttatttcaaccccagttccttctccatcaattctagctggtatttcctgacttctcctctgttaggtaaggaccttcctaaccttttcccaccaccccgtatccacccctcatattgtcttcgctagctttccacttacgagactagtaacattttcttggatcttaattatgcttattatttcaactttatctatagtttgattctaaaagtagaaaacaactaacccttatattataacactacagctattattagttgagtcaactggcataataggactctctttttttctgtgcagtaacatattttaaattattatcgcagataatatattttgctctgtttacttttttttaaagcattagctattaactcttttaagaaaaaacaaaataaagcaaaaacctgtaccatcaatgaatgtacgaccccatctgcaatgacagaatactttcctcccctttagacactggatatttgagtggggagcttctcaaaggggtcatctacacatttgttgtatgacatttactttttagtgccttaacttgccttgtactgtacctcacctctgtctcagtcgacaccctaccctgctcatcccaaccccaccctgggtcaacctcctgttcaccatgactccagcccaactcctccaaccctagctcacctccagagctctgagtcttcacctctccagcctctctccaacctcttctcctcccgggcaggggggctaacatcagaccccgactcaatgacccactcactccccaacccctcaccctggctcaacttccctgaccctggctcacctggatccccattccagcacaacccccacccctctcaactcacttaccctcaccccctcatgaaccctctgccatttaaggatagttcatctccttttctgctgcaagactactcttggctgttgagctacagttttttcagacccaaggcctgtgctgtctctgagccgaattctggtcccgtggcaaggcagaacctgtcccagagtctctgcagtgagcaaagcctagagactcaacagcgaggagtaaccacatgtgggagctgtcagctcacggggattttctctcctctccaagggcaggaattctcttcattgtcacagacctattccttatttaaagctttttttcactcttattcagggagggatgtttaaagagatcatgtatttattgattgattgatctccaatactgcagaaaatatgcattttaaaaacacacatccttctttttttttttttttttttttttgagacagggtttcttgctcttgttgcccaggctggagtgcaatgcccaccacaacctccgcttgccgggttcaagcgattctcctgcctcaggctcctgaggagctgggattacaggcatgcgccaccacgcccggctaatttttgtatttttagtagagacagggtttctccatgttggtgagactggttttgaactcccaacctcagctgatctgccctcctcggcctcccaaagtgctgggattacaggtgtgaaccaccacgcccagccaaaaacacattcttctttctacttgttattcccttcgtgcatgcactcatccccatgcatgccgagggcacatgttctggaaggcccctgggagccacatggggttcacgacctcaaaactgaagccctcagagggtatttgattcattaggtggggtaagacatgaacctaagaagaacgactccttgaaagaaaatgaggtaacaggaaaggaattcactgatacatgtcaggaacccagagctgcctgcgatgtgggtgggattcggcactgggaaaccttgtgtgtgggtccttcggggaaagtgggagttgactgccgttgagcgggtaggaaagtgccttccaggtacaggcagcaggagtggtgattgtcttggtagaggatgggtgaactgcaaatagagttgaaggagctgggctgagtagttgggatttcactccccgggtgattggtgggacccagcagggccagtcctgggcttttcctatggcaagtaactcaagagctgcaggagcagatgttgttaagcagagaggaaacaccaaacatggatccctatctctagcgagtgtgccctgtgactgtggagggtggaggggagtcacgccagagggaggtgctgtgttggggccagaccggagggttacatcctgagcaggagaggagggaggaggccaggtggaggagcggcctgggggacataggtggttgtggtgctagattggcagtggatttttttctgaaggctgccgtaacaaatgaccacaaagtaggtggcttaaacatcagaaattgattctctcacaattctggggggcagatgtctgaagtccaggtgacagcagggccacgctccctctggcagagctgggaattctgcggtctgtgacagcatcgctccaatctctctctgtcctcatctgtcctctgcacatctgtgtctcaaatctccaggatgatctcatcttaggatccttaattatgatctataaagatgctatttcccaacagagtctcattcacagcgaccggggttaggatgtggacatgtcttttctgggcgatacatttcaacctactacaggcagttacctgaaggagtaactgaaggagaggggttcagaatcctccagtggggcctgatgggcagaggagagacttggacacccttaagagacgaaatgaatcttcagaggttcagccattgcttgcaatgtcatcttctgggctcatccctgcactccaaccctggacattttctctggtcttttctagtggccaccatctggatgattacgactctggaaatctctgtccatcatccatttttttgcctcctctgtgaacgagcaggtgtgatggcctgaaaacagagagggagaaggctgagtgtaccagggcaggggaagcgcttcctggaattacgtgtcccaggacaaaagtgaaactgccttcgctgactcataggaaagtttgaaaatatcatgtttcgcctatgcctgggggatctttgtttttggcataagccgaacagattgttccaggccagaaaaaaactaagccaaaccaaaacaacagaatgacttaattatgtaccagcaccctttaaaattaattatgcttgctttctttttgtccccctcaacttttagtttaagttctgaggcacatgtgcaggatgtgcaggtttgttacacaggcagtgtgccatgcccattgtggtttgctgcacagatcaacccatcagctaggtattaagtgcagaattctttagctattcttcctgatgctctcctgcctcacaccccctgataagcccctgtgtgcattgatccccaactgtgtgtccatgtgttctcatcgttcagctcccacttataagtgagaacatgcagtgtttgtttttctgtttctgcattagtttgccaaggataatgccttccagcaccatccatgttcctgcaaaggacatggtcttgttcctttttatggctgcatagtattccatggtatataagattatgtaaagagatcgaacctacaactgattggcgtacctgaaagacatggggagaatggaaccaatttggaaaacataattcaggatatcatttgtgagaacttccccaacctagtaagacaggccaacatttaaattcaggaaatgcagagaaacccagtaagatgctccatgagaccatcaaccccaagacacatcatcatcagattctccaaggttgaaatgaaagaaaaaatgttaagggcagccagagagaaaggccaggttacccacaaagagaatcccgtcagactaacagtggacctctcagcagaaaccccacaagccagaagagattgggggacaatattcaacattcttaaagaaaaaaaaattccaactcagtttcatatccagccaatctaagtattcataagtgaaggagaaataagatccttttcagaaaagcaaatgctgagggaatttgtcaccatcaggcctggcttgcaagagctcctgaaggtagcactaaatatggaaaggaaaaaaacactcccagccacaacacactgaagtacacagacaagtgacactatgaggcaacaacataaacaactctgcaaataaccagctagcatcgtgatgacaggatcagactcacacatagcaatattatccttaaatgtaaattggctgaatgtcccaattaaaagacacagaatagcaagctgggtaaagagttaagacccatcagtgtgctttcttcaagagactcatctcacatgcaaagacacatgtaggctgaaaatgaagggatggaggaaaatttaccaagcaaggggaaaacaggaaaaagcagggagtgcaattctagtttctgacaaaacaggctttaaaccaacaaagataaaaaaagacaaagaagggcattacataatggtaaaggagtcgattcaacaagaagagctaactatcctaaatatatatgcacccaatacaggggcacccagattcatgaggcaaatttgtagagacctacaaagagacttagactcccacacaataataatgggagactttaacaccccactgacaatattagatcatcaagacagaaaattaacaaatattcaggacctgaactcagctctggatcaagcagacctcatagatatctccaggactctccaccctaaaacaacagaatatacattcctctcatcactacatggcacttactctaaagttgctcacataatcagaagtaaaacactcctcagcaaatgcagaagaactgaaatcataacaaacagtctctcagaccacagcacaaactaattatgctttctaatgtgaacctctaattcttggttatatcttgtacatacatgtgtttttttcttttagttttggatttctggaccttgacatgtttaccaggagtactagattttcttgctatgttccttttcttggcatatgactttgatccttctgaggggttggagtcagaagccaattaccactactttttcctgcctcctcccacatccagatgtctgttctccagcctccatctcttctaagtttgccttctcctctcagtacctggatgtgaccaccccattcagtggcgtcatctctacctagtgactcctaggagacttttgagtattttctgacttctagcctgccccttctagcactctcaatgccttgttgcgttttaaccatattttatattttgttttttgtttttttttgagatggagtcttgctctgttgcccaggctgcagtgcaatggcacaatctcggctcatggcaacctctgcctcctgggttcaagcgattctcctgcctcagtctcccaggtagctgggattacaggcatgcaccaccatgcctggctaatttttgtattttttgtagagatggagtttcaccatgttagccagcctggtctcgaacacctgacctcagatcatccatccgcctcggcctcccaaagtgctgggattataggcgtgagtcactgtgtctggccatgatttttgttttgttttgttttgcttttaattaaaaaaattttttttaatgtttagagacagagtcttactatgttgcacagactggtcttggaactcctgggctctagcaatcctcccatctcagcctcccaaagttctgggattgcaggcattagctactacacctggccaatcatattttatgttaataatacttggttagccaggcatggtggctcatgtccgtaatcccaacactttgggaggctgaggcaggtgaatcacttgagcccagaagtttgagaccagcctgagcaacacagagaaatcctgtcttaaagaaaaaataaaaaaatactctgttgaggtataattgacatatgataaagtacagaaattctaagtgaacagccgtatgattttgacaaatatatacacctgtgcagtcatccccctactcaagatatagagcatttccatcaccatagtaagtttcctcttgctcctttctactcagtccctgtctcatcagaggcaaagacctgttgttcagatttctgtcaccatggattagtttagccagtattgaaaattcagtggaatcacacagtgtgcgctctggtgcctggattctttcactcaacataatggttttgagatttagccatgttgtgtgtaccactaggttgcttttttttttctttccatagttaacaactttattgacaattcatccattaaagtatacaacttgatagtttggggcatattccattattaatttttaaaattgtggtgaaatatatataacataaaattgttcattttaaccattgtaaccagtgtacagttcagtggcatttgcaatgttgtgcaaacattatcactatttccaaaatgtttttatcatccctctccccccagtccctcttcctcctcctaccctcttcccctcagcccctgataacctctaacctattttctgcctttatgaatttgcctatcctacatatttgcataaatagaatcatacaatatttgtctttttgtatatgggtaatatcacttagcatgatatgctcagtgttcatctatattataaaatgtatcagaatttcctttttttaaaggttgaataatattccatcatatgtatataccacattttgcctgtccatttatctgttgatggacatttgggtattccatgttttcactactgtgaataatgctgttaggaacatgagtgtacaaatctttgtttcaacctctgctttaaactcatttgggcatatacctaggagtggaattactggatcatgtggcaattctatgtttagctttctgaggaacaaccaagctattttccacagtggctgcaccacattagactctgaccagcaatgcacaagggtttgtttcttcacatccttaccaaacaaacacttgttatttttttatataggtgtgttttaaatggtagccatcctgataggggtgaagtgatttcttattgtggtttagatgagcatttctcatgactcagtgactaatgatgttgagcattttttcacaggcttattcagcatttgtatgtctgcataggcaaagttgctttttctgctatcattacttcattgagagataatttacatacagtgaaatgcacaactcttaagggtgtagttcagtgaattttcacaaatgaatatgcacatgtaaatgtcactcagattaagatatgattccattaccccaggaagttctcttgtgccattttctaataacccccttcacaattttttattaccatatacagtattaatcttgcctgtccttggatttcattaaatagaatccagcagcgtgcactttttggtgtctggcatattttgttcaatgtaatatgcatgagatccactggcattgctgtgtgtatcaggattttgttcttcttttgttgctcagtagtattcccaagtttgattatagcagactttgcttatctagtctcttgatgaatatttgggttgtttgcaattttgggatattatggataaagctgtcctgaacattcttgtatacatcttcatgtggatatagactttaatttattttgagagagtatccgtgaatggagttgctggctcataaggtagacatgtgttaaactttaatagaaactgccagtttcccagtgtggttcttccattttacactcccacctgctgggaacatgagagttccacacccttgccaacatttggtattgtcagtctttttaattttaaccattctggtgggtgtatggcggtatctcattgtgggtttaatttgcatttccctgtgactaacgatatcgagccctttcacatttggaaaaggttataatttaaattttgtacattaaaaaaaaatcaagttagaagacattaatgaacacctgcagaacagacatcccaaagcccagaatgtcatgtggaagccaccgccctgacagctatgagtcagacagacagatgtcagtttcagttacaccttaaatcacaaatgagttgccaactcagtttaaaaagaatagggttggggggcatatatttaaagaatattttgaaaatagaagaaaatgtggcaaggctgtctcctcccacaccagctcccacctgagagccagatagttagcaggaaaatctgatcacgctgctttctaagaccctgcgtggttctccaccaactttggatgcacttcagcctcctcagccctcgtggaagcccgtcatgacccagaattccccactcgtcagctccacgcctttgcacatgcttgcctcccgcctgggacacggtccctccaccatccctggcgctgcggacctcccaccattgcttggctaacgaggctcaacctggctgggtgccaactcctcccagcctgggcaagttgccagtcatctgtgctcccaccatcctctgggccgagcctggcattctcattgtttacttctctgcctccttccccagactgaatgtcctgaggggagggagtcgcatttcagcaatctttgtattttgaacacacagccagggaccagtaagcctgctgatggtgaataaatgctcatgggtgatgacgacagccagctgaaagcggtgcagccctcctccctgcggggcatgctctccgtggatgtgctggtttagtcacacacattttaagtgtgacgacacctatatattcctaaatctgtaagacaaagtacaagccacaatatctcgagatctgcccttctcctttgaccactccaccccagcctatgacagggggctgccatttccccccatggggccagggatgactcttggtagagcacccaggagctggtgcacatgagaacaagaccagttagggggcatgtgagggagtgctgtaggcatccaggccaggactaggtaagaatttatttggatttatatatagcagagactgggcaagacaagaaggtgggtgcgttgccccactgaaagaaagccaatcaagtaaaaatgaacaagaacacaagctgagctctgtgtcctgtgtccccgaaggggtgactgagcaacctcggtgcctgggtgtagagataacaccaccactgtccatcccggggcctcacccagggcgtcagcggagcatgctcacactttaggtcctgtagacaaaagtaattgcaggctcccagccaggagcctgggctgaggcctgaggatctgcatttctaacacgctcccaggggacgctgatgccgctggtcctgggactgcactatgagtggccaaagtcaaacctgcgcctggcagaaaacagtaaataggtcgtttggctcaatcattagccaggttgttaattctgcatccattggtttgggttgtactaaattaggccacactttttgtgaggtggaccagtatttgtgcatgacaggcccaatatttgtgaaaacattgccttgaaaatagttggagaattttatttctcatgaatagaacatgctgtcgtctgagagcctgcctcagagcagctggctgggagcctccggagtgggaaccgctttggcagagtaggtaaaacattcaaaaagggtttcaagtctttgagtctgaaacgagtggacaatgtagattcctttcatgaaattgtatgcagcattttgcaaggaacttataaagctgatcatagtctatagatcctgaaggtccaatttgctttccattgattgcttgtcatttttttttttttttgagacagtgtttcagtctgtcacccaggttggagtgcagtggcatgatcacagctcactgcagacttgacctcccaaactcaagcaatcctcctgcctcagcctctagagtagctaggactacaggtgtgcaccaccacacccagctactttttgtatatttttgtagagacgcggttttgccatgttgcccaggctggtctcgagcttctgagctcaagccatcctcccgtctcagcctcccaaggatctgggtttataggtgtgagccaccgtgcccggcctgatggtctatttatattctcccaactctttctagaaaaggatgggaggcagctttctgtcttctgtacagttttctcacagcccgtgaatccacttgtgtagttaagcaggagactgggaagcttcatcagaattttttcatccttaaaaaaaattttttttttttgagacagggtctcattccctcgcccaggctggagtgcagtggagtgatctcagttcactgcaacctacgcctcccaggttcaagtgattctcctgcctcagcctcctgagtagctcagattataggtgtgcaccaccatgccaggttaattgttgtatttttagtagagacggggttttgccatgttgcccaggctggtcttgaactcctgacctcagatgatccacctgcgttggcctcccaaagtactgggattacaggggtgagccactgtgcccagccccatccttaaacattttgtattttctgattattaaataaaaatagatgttcattgtagggaaaaatgagactttttacaactttttataacctattcagaatcaattactactgaaggcttagtgcatttctctcttgttttttgtcatgcagtgttaatagatgattttatataattgttttaaatgtatatttatcttatggtaatttaagcctttcctcatgattaaaattctttatatacctcaattttactaatatttgataaatgtaagattataccatagaaaaatgtttttttttaaactttttaaaataatttcaaaaggagaactttttttttttttttgagatggagtttcactctttttgcccaggctggagtgcaatggtgcaatctcggctcactataacctctgcctcctgggttcaagcgattctcctgcctcagcctccccagtagctgcaattacaggtgcctgccaccacacccagctaattttgtatttttagtagggacggagtttcaccatgttggccaggctggtctcaaactcctgaccttgtgatccacccgccttggcctcccagagtgctgggattacaggtgtgagccaccgcgcctggctttttttttttttttttttcagacagagtctttctctgtcacccgggctggagtacagtggcgtgatctcggctcactgcaacctccgcttcctgggttcaagtgattctcccacctcagcctcccgagtagctgggaccacagatatgcgccaccgcacccggctaatttttatattttttggtagagatggggtttcgccatgtcgaccaggctggtctcgatcccctgacctcaagcaatcctcccacctcagcctcctaaagtgctgggattacaggtgtgagccactgtgcctgaccaaaaggagaacctttttgaaaaaaaaaaaaaagaaaaaaaaaagaaaaatatagcactctcctggtgtcttctgggagtatagtgaagtccagagaggagattttcttagctgagttgcagaattaattatatctaatctcgctgcacctaacatctagtagatctcaatggctaataataaaatactaatatgttttatttaattatatattgtcttatataaacatatattcaactttaatgaatgatccagttctcaagacagaaacatagaattatatgttaatatgacaggctttggaaaattgtaactggattttgtcattattctatccttatgacttgttgatgtttgtattatctaatgctacatgcatcaccccaaaacacagtggctttaaataataattatcatttattttctctcacagtgtctatggctcgggaatgtgggaacctggttgggcagttctgactgagggtttctcgtgagttgcagtgggatgctggctgtggctgtagttgtctgaaggcttgactgaggccacagggtcctcttccaaagtggctctctctcgtggctggcacattggtgctggcagttagctgggggcctcagttcctctccctgtgggtctctccatagagctgcttgagtgtccacagggcgtggcggccggcttcctcaggagcctgcaatccaggagaccagggtgaaagctgcaagatcttttaggatctggccttggaaggcacacaccattactcctgccatatggggccagccctgatgcagcatgggaggtgatcaccaaggatgtgaataccaggaggaaacgaagatcattggggccatccaggaggctggctaccacagttgtggttgtgaatattagaagtacagggtatggaatgaataagaaaagtatactcatgacagacatacatggtactaggacagggtctgtgtttttgctgttgtaattcatcccctgcatgacctctttctcattgagtttctttctttccttttcttcttcctttttttttttgaggtggagttttgttgttgttgcccaggctggagtgcagtggcaagatttcagctcacagcaacctccgcctcccgggttcaagtgattctcttgcctcagcctcccaagtagctgggattacaggcactcgccaccatgcccagctaatttttgtatgattagtagagacagggtttcaccatgttggccaggctggtctcgaacatctgacctcaggtgatccgcctgcctcaacctcccaaactgctgggattacaggcatgagccaccatgcctggctgagtgagtttctgtgttccgctcttctagccttgctagttcctttaagttctctgtcgagctttgtacatctgttgtaaaaattccaagcttaatttcagaaagattaagtgaatcaatggttggaagaacatgtaattgttactgacagtcactgccttcaggtcaacggttaacaggcttagttttctttcatcacataatgcttgtatgatcactgcgtggaaaccactcccagtgttgggaaaattagatgagcctctgagataggaatagattaggtatatacatgaagttggcagagggaatacagttgaacaaagtagtggtttcatacattactaatctaaaatcataaatcccagcgagaggtttgcagtgataataagatttacgttttatgcaaaatttagtctaaagggaaattgttttgaattactgacaaccttgaatttatcaaatcctgattacagggctacaaggtgaccccatgttggaaggaattatcttgatgtattttacatatttatttattttattaataaaatgtcatttctttatttaaaacagtttattaggcatctctttatttgaagcagaaaagcatagataaaaatacaaatattggcctggcacagtagctcacgcctgtaatcccagcactttgggaggccaaggtgggcggatcacaaggtcaagagatcgagaccatcctggccaacatggtgaagccctgtctctactaaaaatacaaaaattagctgggcgtgttggcgagtgcctgtagtcccagctactcgggaggctgaggcaggagaatcacttgaacccacgaggtggaggttgcagtgacctgagatcgtgccactgcactccagcctggcgacagagcaagactctgtcttttttttttttttttgaggtggagtcttgctctgtcgcccaggttagagggcagtggcgcaatctcagctcgctgcaagctccgcctcccaggttcatgccattctcctgcctcagcctcctgagtagttgcgattacaggtgtgcgttactacacctggctcatttttttgtatttttaatagagacaggatttcaccatgttggccaggctggtcttgaactcctgacctcaagtgatccacccacctcagcctcccaaagtgttggggttacaggcatgagccaccacgcccagcccattttataagtacattttgtgcccaatcaagtatcaaagacataatcttaaaataaaggacagttcttcccaagggaaaaagaaagtaggcaacctgacacatgaatagatgatgtatgctactgttacacgcacacacacacactcagaatagactgtgatgctgtgataacaaaccacttcaagtcccagtggcttaaaataacaaaggtttgcctctcgctcattcatgctgttgtgcgccggctagagggggcagggctctgctctctctgccctcactccggaggcccagtctgggagcagttgcatctctgagcttcaagggcagtcaagtcaagaaaagggaaggtggcacatcgtccaccgtctctcgaaacttcctcctggaagtgacacctgctatttcacttacgtttaattacccaaagcaaaccagatggtcaagtcagaactcagaaagggtggggaaatgcaattttaccaagaggcaggaagaaatagataacggaataacgccagtgagtactgcagctgaatccagtgcaactgaattgtcctggttcaaacaattaaaaaagactttgtgtgtgtactttcaccagcttcttcacagaccgtcgcccatacttgagtgaatcttcctcctgtgcatgctactgtatatgataagtggaagagaatagagagtgttgtcagggacatttttgaggaatactgaagtctacttgggacagtgaaacacactggacgatgagcttccagctgcttgttttcctgctggactgtctgtgagttcatcttcttatttaaagctccttgttactgagtgcctcctagcagcagtttcctttagccctctctaggaggagcacaaatgcctattcctggcagcctgagcatgtcgtcttaggcgtcctctcgtgacctgtggtctggtgttttgcacaatcttcatcaccactccttctagaaggactgagaactgaatttgacttttaaaacgaagcttggtaatcaagaatagcaacagcaggctgagtacgggggctcacgcctatattcctaggactttgggaggctgaggcgggtggatcacttgaggtcaggagctcgagaccagcctgatcaacatggtgaaaccctgtctccactaaaaaaatacaaaaaaaaaaaaaaaaatgggcgtggtggtgcatgactgtagtctcagctactcaggaggctggggcaggagaatcgcctgaacccatgaggcggacattgcagtgagccaagattgtgccactgcactccagcctaggcaacagagcgagactccatctaaaaaaaaaaaaaaaaaagagccgtggtagttctgaaggggaagagcaaggaaggtttcttccctgcaaaacacaaggctgcagtagcgaatcaggattgccttggggctgaggtagattgttagaccaatgggagcaactctcaggttcattcctgtgtttatggggaggtgggatgagcttgagcatgctgttactaccaatgggaaaagaatggatgtgttcatatattgtgctaggaaaacagaaaaaggtaaaattaaacttctataataaaaaccatggtggattcaagacctcactatgaaaaaaaaaaaaacttgaaactgttgaaattaaatacagaggaatatctttagggtttttgaatgggaggcattgcttaaacgcatgacaaaaagcattcctataaaggaaaagattaataatatgactgcatcgaaacgtaaaacgggatggtaaatgaaaaacaagtggtgtcgagaaaacaatcgcaacacccttgacagagcttcaggtccaggggcagcatttacagaggcacctactctctgtggtgcctgagagggagcgcctctttaaatttggtgccccagggcctcctttgccacatcttagtgccagccttgggcgccagtgccatcctgatgccagctttagtgtctagggctgtattgcccagtagtgtagctggtacctccaagtggctgtggaacacagtgcaactgaggtgtgccgtaagtgtaaaatatgtactagattcatccaaaaaaggtaaaatagctcattaaaatttttctattgattacattttgaaatggtaatattttggatatgttgagttaaatacaatatatttattaggatttcatttggcttttattaatttggccactagaaaattaaaaattatcagccaggtgcagtagctcatgcctgtaatctcagcactttgggaggcagaggtgcgcagatcacttgagcccaggagttcgagaccagcctcggtaacatggcaaaacaccatctctacaaaaatacaaaaattagctggatgtggtggtgctcacccatagtcccagctactagggaggctgaggggggaggattgtttgagcctgggaggcgaaggctgcagtgagccgtgatgcactccagcaggtaacagaccaagacctgtctccaaaaaaaattttccattacatttgtggctccccttatgtctttattggacagcactgtcctcaagtattataaagaattcaaactgggctaggtgctgtggctcacccctgtaatcccagcactttgggaggctgaggtgggcagatcatttgaggtcaggggttcgagaccagactggccgacgtggtgaaaccccatttctactaaaaatacaaaaattagccaggcatggtggcaggcacctgtaatctcagctacttgggcagctgaggtgggagaatcgcttgaacccaggagatggaggctgccgtgagctgagattgtgccattgcactatagcctgggtgacagagtgagactccatctaaaaaaaacaaaacacacaaaaaaagaattcatactgatcaatgaggaaaagacaaagaagccaatgggaaatggacaaaagacataattaaatccttcaccaaagaggaaatccagacagccaatagatgcatggaaaggtggccagtcttactggcaatcaggaatgcgaagtgaaaacacaataacaatgtttaagcatccgattggtgaaaatgcaaaggtattgggaattggtgagaatgaagaaaaactgtaactttcacccatgagtggtggagttgaagttgttgcagccgctttggagaggactttggctcatgttctacccccagcttgtccacttagagcactggttctctcctggggcaattttgcctcccagggtgcatttggcaatgtctagaggcattttgggttgtcataaatgagggtaggagatgctcctgacgtctaatgggtagagaccagggattgcatagtacaggggacagccccccccccgaataaagaattatctggccccacatgtcaatagtgccctggtcgaaaaactgacacaggcgaggatcgcaattaatttccagctcaggtgcatcaggagatacagatcaaggttttaatttcagtgctctctgtatttgtagtcacagaactttggacacagtgtctatcagtttaggggcatggatgaacatgcagagacactatagcagtcacgatgcatttgccagtgatttggctgaatcacgtccagcactgcgtgaataaaccaagtttcaggctcagatgtacatggagagcattttgtgcaaatagttgcaataggaaataatgctccctattaaatatatcgcttgggcacagtggctcacgtctgtaatcccggcactttgggaggccgaggtgggtggatcacctgaggtcaggagtttgagaccagcttggccaacgtggcgaaacccgtctctactaaaaataaaaaaattagctgggtgtggtggcgggagactgtaatcccagctacctgggaggccgaggcaggagaattgcttgaacctggggggcggaggttgcggtaagctgagattgcgccactgcacttcagcctgggcagcagagcgaaactccttctcaaaataaataaataaataaataaaaatatattgtttatggatacatgcatatgtaataaaaattcaaaagcaaaatcagagcatacacagctgcaccaaatagtgatcacctctgggagggatggagaagaaagcacaaaaaggcatttcaactttttctgtaatgttgattcctttaaaaagtttgaagccgttatgacaaaatattgacctttgttaatgttaccaatgaagacatgggtgtttatcttacttatcttactttctattttacttttctctatatttggactttttctcataataaactctgatacacacataccaaagggcacttggaacaggggctgcctgagtctaggcagctcagtgggggttgtccctgtgtctgtgtggttcgcctgcttttccccaacactgatctgtggttaagagtttggtgcatggaacgttccatgggattctttattatgagctggctttggagaagcagtgggctgaaatggtggtgtctgacctgcggtgctggggccacaccctgtagggattgacccttgggtcctgcctcccggccaggaagtcctctccccttgccacttgccacccctctgcactagacctgggcctgacctttaccctccaaacttctaacaacacatcccagaaaggatctggttcaagatactaacaatcacacttggggagtgtatttcaaggaaaatagatggcatatcgtagaaattgcagacaaacctgaactcctggggagtcccttcagaaaggaagtttgctgcctggttgagacttgattgggaagggtttgccttgtatgacacccagtgcctagtgtagtgtggaatttaaggccagcaggtggtgattgatatgcacacttggtcttctctacaggccacatgtgttgaagattccctgccttactggggcctccctctcatgctctttcattctgtttaggcccagggaaaggattcctgcctgtggcgccgggcttgaggctgcagtactcaccatttttctatgatatgttgaagcaatcaactggtgttgagggatcttagaatttttaagacttgtatgaagtatccttccctttggaatcttgtttggagaatagcttaattagatgatgtcttagtccgtttaggctgctatagcaaaatacagtaaactgggtggcttataaacaatggagatttatttctcactgtttggaggctgggaagtccaagatcatgggcctgctttctgtttcatagacagcaccttcttactgtgtccccacagggtggagaaggcaaggcagctctctgggtcctcttgtataagggcaccaatcctatttatgagggctctgcccttatgacctggttacctcctagtggccacatctcctaataccatcaccgtgagggttaggatttcaacatatgaattttgaagggacacaaacgttccgtccatggcagatggtaaggctctgtcaccagaagaacatttgagtcagtcttcattcacgctgcccgagtattcttgcattacctgtgtgaactgaaccaggaagttgtcccctcacagggaatccatctctcttgcgccgttgcagctgctgcgaccaaatgctgtcatcgatgtttatcctggatgcccaccccgtccccagcgcaagattcttttcttagacccctgatgattttaatttgcattgtcttaaaacatcctgagatgattgaaacttgcctaaaatagtttacccagcaaatcacacatgtgttagcaggggctcatggcagccttttagaaatatagtagctctttagaggccagaattcttgcattcattcataaagccacatagacatctcccccgacctattgctggtgttattatggggttttatagaaatggagttttaagtatctgaaatgtactctcttcgttcttggaattttttctcacactcgagcatggtaacatcctttttcttctggggcatcaggatgatggctcccctactgtggtaccataggccccacgtggctctggggctccctgggcctctggtgcttcagtctctcccctggctgtcgtgggctcccgcttcttcttctgcagactgtgctgggcctcacgcagcatccggccctcctttttccttcagacagctcttgtttgcatttgtttatagtggttattgtaaaactatttcttaatgaggatttttttttttttttttttttgagatagagtcttgctctgttgcccaggctggagtgcagtggcacgatctcagctcactgcaagctctgcctcccgggttcatgccattctcctacctcagcctcctgagtagctaggactacaggctcctgccaccacgcccagctaatttttttttgtattttttttagtagagatggggtttcaccgtgttagccaggagaggatgttattaatgtaaacattgtgtttgcttacttttttcaatgttaattaaaatgatataatttcctcatgaatacagctttgttttacataagaattctaactgcacagaatcatatggggtggctcacgcctgtaatcccagcactttgggaggccaaggagggcagatcacaaggtcacgagattgaaaacatcctggccaatatggtgaaacctccatctctactaaaaatacaaaaattggctgggcatggtggcatgcgcctgtagtcccagctacttagcaagctgaggcaggagaattgcttgaacccaggaggcggaggttgcagtgagccgagatcgtgtcagtgccctccagcctggtgacagagagagactccatctcaaaaaaaaaaaaaaaagttgaaagtagttcttccaaaatgttccttccccaccccaccaaccctggattagtcaggggtctccagagaaatcgtgtgtgtgtgtgtgtgtgtgtgtgtgtgtgtgtgtataaacatatatgtagagaaggagagagatttgaggaactggcgtgtgcgattgtaggggctggcaagttcaaaacttttccatgaaaagttcaagatctgggtaagagttgcagtttgactctgaaggcagtgctgccggtcaagtttcttctttccagggtgtggggaggccagccttttttctcttaaagtcttcagctgattggatgaggcccactcacatgacggagggcatctactttcctcaaagtctgttgatttaaatatcagtctcatttaaagaataccttcacagaaatagctagaataatgtttgaccaaatacctaggtactactgtggcctagccaagttgatacatgaaattaaccatcacacacctcccattcatcttccttctgttcttaatattttggtgtggttcttctagatgccatctcactgtcttgcccaggctggtctcaaactcctggcctcaagtggtcttcccaccttggcctcctaaagtgctggaattatagacatgagccactgcacctggcctcatttaatttgttaatataataagtgatgttctggctgggtgccatggctcacacctgtaatcccaacactttgggaggctgaggtgggtggatcattcgaggtcaggagtttgagaccagcctggccaacatggtaaaaccctgtccctactaaaaatacaaaaattagccgggcttggtggcaggcacctgtagtcctagctactcgggagtctgaggcaggagaattgcttgaacccaggaggcagaggttgcagtgagccaagatcacaccactgcattccagcctgggcaacagagcaaaactccatctcaaaaaacaaaaaaagtgatgttcttaggtttctaaatgttatatcagccttcccaaggtggctgtcagcaggtgcctgctgcacattttgggaagttttaccttaggaagctggaggagtgtggtggggagaaggaggtgctattagtccagagcagaacccttcactggttgaggtgagaaggagggaagagtagggtggtcctgaaagagacctaattcaggagccagatacttccggaaccctgagagtgtctctcttgtatccacctagggaaggcattccttttaacctgagccctttaagtgcaggttggatatcagggttggcaaaggcagatgccatctgggaccttcctgaagagcaggttagcatattccaagctggaatatgctaaaagctttcaaaatacctattttctttaatccagaaatcctgcttctaacaatgtctcctgagaaaacgagaaacaaaatacacaaagccttagctctagggcttttcattgcaggttttactcatgagaaagaaagtgagaaacagatcatctgagtatccaagaatagggatttgttaaataatgacaattctaccccacatagaataggatagtctgtatctaccaggaattttgacacagagttacttttattgatgtgaagatattgctgatatagtcctaactaagacatatagcaaatggtcctgttttagtttgaagaaaaatgtgtgcatatgtgtgtgtctggtctataactttttttcttctctttaatttttggatctttttctgcaataaatatgaattacttgtgtaattatatgcaaaggaagatgttacattatgttcaatatgttttatttataagtcaggaaattgtagaatactagagcaatatctccatccaaagaagttaaaaatgatttttgggtgctccctggtgggatgacaagttttccggcacatttatgcgaaagcaggtgggtaggttagctgggagaatggaggtggtggtggcagcgaactcttagttcccaaagaggctgaaaacctcagtggcttttaagtagagcctgcctgcagcccactcttttctatttaaaattagattattgtgaaacatttcaccatatagatggaatgacctatttcaaagggtgcttaagctagattatattaaagaggctttaccatagtcaacagttattgagttgattatgctgtggtatggatgtcagtgttagaaaatcaatggtattctgtagaactttaaacatgtgaatatttgtgatttaatattcttctgtggggcaactaggagccttattgagataagtgggcagggctactcgagtcctcttgttgttccatgaaaaattatattcttactaaaaattggccgggtgtgttggctcacgcctgtaatcctagcactttgggagactgaggtgggtagatcacgaggtcaggagttcgagaccaccctgaccaacatgatgaaactctgtctgtactgaaaatacaaaattagccgggcgtggtggcacatgactgtaatcccagttacttgagagactgaagcaggagaatcgcttgaacccaggaggtggaggttgcaatgagctgaaatcgcaccattgcactctagcctgggcaacaagagtgaaactctgtctcaaaaaaaaaaaaaaaaaatctggtgaagattgggctgggccactgtggagttgctctcaatataaactttgtgcctctcatgcagtggtggtgtgactggcagtgccaagagtgacacttgattgcctggtcattagctcctgccctgggttgaattttagcatctcaccgtatctacgtctgtgaggcggtgagcctcacacctgagtctacgctgttttcctttgttacgaggtctcttcgtcaacttgggttgctgcaacaaagcaccatagactgggtacttattcagaatggaagtttattcctcacagttctagaagtccaagatcttttacagagtggaaatttatttctcacagttctggaggctggaagcccaggatcagggcgctagcatggtggggttctggcccgggccctcttccaggatgcagactgtagacttctctctgtgtccttacatggaggaaaaaggcacaagagagctcttgaggtcctttttataggacactaatcccattcatgaggactccaccctcgtgatctaatcaccccaccaaagccccacttcctgcgccattccactgggagctaggattttaacatttggtaatacttaattaatagatctacaaaatcaactatcagtgtatgtatccagcttggttctctctccatgactccacgctgctattcatctctacctgacgtcaccactgggttgtccagagacagtctcccacagtacactgaagtctgcgtgccatctgtccccacgcccgctctgtcccacatcctgtcgctctcatttgatggcaactgcatcctctcagctgctagggccgaaactctggggtcatcctggactctttttctattcaacctcacctccattctaacagcaaatcttcctttccagaatccaaattcgcctccccagctgctgcccccaccctggtgtgacaccatccttgcctgcctggccccacagtggtctcccatcagcccccttcctccaccccattcttctagagcctgtttcccacccagcagccagagtggatgcagatgattggcagccgatggctcaggacactccccctactcagggggtccccaggcccctgtccacggtctctgagacctcctgttgcctcctggacccgggttactcctcctcttctcactcactctgctctagccctgccggccaatgggctgctccctggatgcaccaggcacagtcctgagttggggcccttgcttgagctgtttcctctactggggcattttcccctctctgtgtccctgtggcccactgccttgcctctttcacacacggaccccaacatcacctctgccaagcccagcctgaccactctattccctagagagctgcacccgccctgcacacaccttttttaccccatcgccgtctgccgtgctctgtcgtttatttctctacgagccccatagttggtgtgtttccctccctggagaaagcacaccccaggagggctgagaccttagcagttcactgatgttttcacgtctaggccctcactcgagtcagtgctcaacacacatttgagaaggatcgagcggctggctcactctaaaccatctctgagaattgggactccaggtccctgtcattgccttgtccagccccctggagggtagtgggtgcccctcggggtccccagtgctgacccaccatgctccgactctgcccctctgacccgcttcccctcttcatttctagaccggccttattgtcgcctgctaccacggctttgtggataccgtggtggccttagcagagtgcccccacgttgacgtcaactggcaggacagcgaggggaacacagccctaatcacagctgcacaggcaggtaagagctggctttcccctttcctctcagagccgtggccagagcaccgccgccgggcagcccgggctcccgttgcgatgcagtcaggatggaaatgatcagagaccatgtcctgctaccaaggggtgccagggaagggctgattgctgtgaccacacgctatgcatttacccacttgttcagaattcagtatgggcagatcaagctccgatactgcccaaagtttttgaatatgaatctgtaccagaaagccacccttgtcaccgcttcacctgaagcctcacactccatcctgctcccgaagactgggggtggcacgaggctggcagacccaccagtggaagagacacaatcatgtgtctcagtgatagttaatcatgaaagtagacacgtgtagaaggtgactttgcacttcacctgtagagttaaagaaacgccaggaactgtttctgagagctgttagagtatccgtgtaacaagctgagatgaagtcagtgggagcatcttgtgagcgggtatccaagcatgtggccctcagcccatcagtcatcaagaagacagtgcttatgtcaatattgccaagtgcattgcgactctcctgctttggaactgtatccagacatttttttgaggacagacatgaaacctatgcttgcctcttcataatcacacttcatttggaacagtggtcttgaccaggtttatcactgacccctttcacatttctttgcctccaaagattctgtctgtttcatcggtcaagttctcagttgcaagcaaagaagctgcctgcagctgagccaggaagaacaggcgcttgtgtgttgaaggaaggaggggaagcttacacggttgtcgggttgttgagaatcccactcagggcctggaaactggaggaagtgcccccgaccacactgtatgttgattctggttgggaaatggctgttgctgtcaccaaaaggagacctccttgtcccttgttgcttcacaagctcctggaccaaagccaccctgggtggatctgatgggtggggggccagggaggctggaaaaccagtgtttgacagtttcatcccctgtggtgggagtggtctgggcaccctacttttcaatcaagacgaatagagtgggggaactcttcaaacttagaaagggccaggggctgtgctaacatgtgttcacctcctcaggtttcgaagcgtgaggcatcacttccatggagggttccaggctttgaaaacctagcaagagtgtgaaagggctttgtaaggcattcagtgattcgtttcctctcgtgggccagctgccatgtcagggaccaaggatacagaagtgcagggcagccccgtccttgagtaattctgcagctcatgggacagagaaacacacgaagcccagcaccatctgtctgccggagcttggtgctgtgggatgagaacactctatctagcctgaagttcatgataaggtcttgcaagaaggggatttgagctggggctgagagggagccgggcagttctcaggaatggcgagtcttagggacagtgtaggtgggcatggctgtaggatggcgtgtgtctaggagagatgagggaaggatggggaccagaccattaagggtctaagcccaatgcaagggaatgtatttcagtagcgtgaggctgcgtgagtggtgacaggggtgagaggatcccaggggcgtagcagagggctcagagcacagggaagggccgggagctgtgtggctagaaacacagttggcggtggtggtgatgcgggccatggaggagagctgggggtctaggatggctttgggctttgggacaggggataacaccaactgcaaagggcatataagtaaaagaagatgaatgggaggaacattggttttgagctggctatcatgactttgaaatgctctgagacctctaagtaaagaggtctccatggcaagtcaggaagagaaggagctccaaaatctggtccctgctagaaatacagatgagggacaggtgttgctggtgagagctgggacaaggattaggtcatgacaatatgagaatgtacgataagaggggatttcttttcttactgatctgccagagctctttgtgcgttagagataatagctgtgctttgatacccatgaggtgctttccagagtcttgcctgtttgcaggtgttttgattttatattcacccatgattgtttcttcagagtcaggagcacatcgtatatttttggcaagaatatggcattggccatgatatgtccttggtgtgtcctatcaggacacatactgccagtgtgtcctggtgtgggtgatgctaaatttgacgaactgcttacatttctccattttaaaggcagatatttcccctctgtaattagtaagtaatctgcaaggtgatacttagagattgtatgaatatcctgtttccccaccagtttttgccattgataatccttttctgaatcatttattttacacttattatctgatatttttctataaagaagagctttcctttagccccaccctttttttggtaccattactcattttttaaaaatctcgtgtgttctacttcaataacgcctttgttcttttcagtgctgaagttatcccaaacccagccagttggtaaccctgaagatggctccagtgtccttttgtcatatttctgtcagttttgagtattttcttgatttatggcacaccaaagtgttccacattctccctggactttcccagtccctgtctgtaaccagctgtatcttcaaggaatgatagttctttttttagtgaggaatggtatttagaaaccaaaatctggactctagctgtgctcattcacactaaatgttattgcttctaggcatttcagtgagcagagttagaaaaaaaaatatttaaaaaataaggatacctccaatccaaatgcaacaccatagtattcctcctcttcaccctttccatatgcttcccccattctttgtcggcaagaaacctggtttgcagcaatcacaatgcatttacccattttcctgtcctacgacaaatgtgcacaaagtggtgatactaaaggataattttcaaaagcttaaaaatttgactcttaggtggacagaaagtgaaaactcattaattagtgatgggctagtaattagttaaggccagttcaaaggaaatttgaagaacaggcacatagaggcaatcacaaatgctgaaatacatctgctaatagatgcaaaactggttaatatcctataaggcaatagaatataatgttgtgggttatcttttctataaggtgatgttatggactgaatgtttatgtcctccccctcaaattcatatgttaaaaccccaactcccaatgtgatgcattagaaggtggggatttggggaagtaattaagtttagatgagatcatgagagtagggccaccatgatgggattagtgtccttataagaagaggaagagaccagagctcgctccttccccaccatgtaaggacacagtgagaagacagctgcctgcaaacaggaggaggagcctccagaactgtgagaaataaatgtctattgtttaagccacctagtctatggtattttgtcatagcagcctgagctataacaggaagtaaattatatctctaccagatacaatgcaattgccttgctgtggacaatcagttttacagcttaacttctaaccttgtagagttgtggagcagcctaggaactgaatactgccagagggtcccctggacagcacccagaaccccacatccagcaccagcacttccctggagggaaaagagacccagtcacctcattagctcagtttccagctatgaacagtttttttttaaccaaagaatcagaaattagaataccaccactgctaccagcatcagacctaagtaaaagcccatatttctttgtggttgttttcttccaacatattctaccaaaagttattggtcttatagcaccatattcaaaaacgcggttaaatttttttaactttatgcagtctctccagatttcaaattgcttccctttccacaaatgcttatgtttttcactgagtcagtgacctattgaatttttctaagaatatggattgttaaaatttgaaaaatgttcttttgcttcttgcaataaaccaatttcattttttaaattgtttcctaggcactagacaaccggggagcaatcgatctatttcagatgaagatgctgccctgaaacctgtagcccagccccttctttttgaatctcactgtctttacagtgatccagggttgttttttgtttttgctttattttattttatttttttttttttctggcttgctcattcttctgcagggactgtgctcatccttctctggtttattttaagtcaaggatgacacaggtcctcttggagattggagggctctctggcaaaggaagaaggaaagggctccagctgatttccatccaggctcagtgcccagcagcctggggcgtggtgggaagaactcgggtccaggtgcaggccccgcagccactcccctcctgggctgtgtagttttacttccaagttgagtgtggcatgggagcctgtaacaaccaaggagcagcccccaccctttgcctggtgggacctcagggggaaggtggcctcgggagcttagtgccctccctggcctcatgtgcctggagtgttgaaaaatggcatcagtgggtctcaaagcgtccccatagaccacctctccttttctgcccttctatctgtggggcattgccggaattttgcagggttcactgaattaggtgtaataccccatcctcctcatcaacagaggcctgtccctgccatcttccttaaggaacagaaattgggtggtgtccctcgatggttctagtcacactcctggcttctctctgttgcctttggtcacagatggtgtcttcatctgcttaggctgtgataaaggaaataagcagctctctggggcctcttttgtgagggcactaatcccaccacgaggacccctccgtcaggacctaatcacctccgaaagccacctgctgtagtgtcatcctggaggcaggattttcgcacaggaatttcggaggacagaaacattcagactgtggcaggtgggaagctggataggagggaagattcctgtgttctcagctctcttgggagctggcccacccaggggtagccgtgctgccagacagagctggagtccaagtcaggtagcaggatcgggtggccggggtatgtaccagggtctgggctatcctgagggcagcatcacagctggaaacctgcctgggtggacaggaggaggcgggcagaggcctcagccattatcctgcttcctccacttggcctggctgatgttcttggaggctgattttaaaatacaatacacagtgtttggggggaaaatgaccccacatgagcaaggaaattagaggtgaatacctcttccacctcactgtcagccctctcttcagtctgctctctggagataactgttgttaatgatttgatgcctagatgggtttactctgccttttcaatttaaataaaatcattattataatgtattttttctttacttcttgttttctttcgttctttctttcttttctttttttttttttttttgagtctgagtcttgctctatcgcccaggctggggtgcagtggcacaatctcagctctctacaacctctgcttcccaggttcaagcgattctcttgcctcagcctcccgagtagctgagattataggcgccagtcaccgtgcccagctacttcttgtattttcagcagaggcggggtttcaccatgtaggccagactggttttgaactcctgacctcaagtgatccgcccaccttggcctcccaaagtgctggaattacaggcgtgagccgccgggcctggccttttttttcttttttactggcttttgttatcttcccctacttactgatttgcttgagctctctgtggccgccactgtgtgcacccaccctctggcctgggctctgatccctggacacccaacctaggctgctgcctgaggctttgggactgaattgttgaggttgcatacggaggcagaggggagagggactttacaccatttaaacaaacacagattaaaaagcttccttgtgtgtgtcttaattgcctcaatgtgccgaagagattttccctaatttctttctgaacctccaggggctgcccctgtccccatgggcatagtttccttagacactggctcccaatcttgcgcctccggcgtcagcatcacctgggctggctcatgtgagcattaacacagatctggtggaaacacagactgccaggccctgcccctggagtctttctttgaataggcctggggtggggcccaagaatgagcagatcaacaggtttcctggtgaggctgatgccactggcccagggaccccacattgaggatggagagctttgaagattttatgcctgatgacggcaaaggacccctctcagtgggcactgaagaccagcagagtcacagaccccacgagagatgttgtcagacagacacagaggcatcacggaattaaagtgaaaatgaggaaggcaggtgagcatgtgttcatgactttcctgtgctgttttgccaaagaggctgtttaggcccaatcaggtgatgtcccattttaatcaatttcataaccagttttatttctttgatgatttgttaatttcaaaagctgtccatgcatatttgcttacagccaaaaatgactacaaaagtattatcagggaggaagaaaaagatcccttctctgtcttccaaatattccagctcccttatcagcactcaggagtcacctcttcagacctcattcagtcctttccaaacacacacgtatgtatgtgcgctttgtattcacatgactgggctagtgctgttgagactgtgtttttagtggttttgttcacatggttattaatctagaagctcctgctgtgtcggtgtccctgagccctgccaggcgctcgtagccctgccttcctgcacggggatgtgtggctcatgcccggttccccaccaagacttcaaatttgagaggctgcgttatgactggccttcactcactgtggtggacccggctcttaggccagtccttgaacatgaagtacttgcttcttaaatatttgttggaaaagaggatattgtgtaaaatgcatgaaccgtggtatacttaactgtcccagttactggacaggtgggcttttgagttaatcaacggcagcaaggctgtagtgaagtctttggatctggggtgcatctctgaggacagcgtgttaggatcctggcagcttgaagcatgttgagtgacaggtggtctcagagggctgaacagaggagttgatgagggcctgtcaattacggggggaagggtagagttaagggaaccaacattgaaaggattaaggggagggactctgcagagagtgacccaggccaagaagctggaacccgagaggcagcctcggcctagaacccgagtgacacaggccaagaagctggaacccgagaggcagcctcggcctagaaccgcagccaggggccggagtgggaggcagggccagatgtcccgctccttccaccctggtcccctgctgagccaacccagaaacctcattggggcggaaactgggcaggtgctgttggtgcaggtcagcttcctaggccgaaagcagggcaaggaagaggagaagcaatgtgcagacacactcttagaacagaattgcttcagcaagggctgtgcctgttttaagtgtatgcagctgccaagtggtctttagaaagctgtggcgatttctcctttcccctgagtgtccaagagtgttcttgcaagccctggctgagatcagtcttttcagtatttccctactcaaatgaaccaaaactctggttttcagttgtatttccccagctctcttttgagcctagtacctgttaggatgcttttggcttcaaccacaaggacactgccttctcttgcaacacaagacatctgcgggcgatgttgcagggttgcttcactgagtagctgggtgatgctgggacctagagccacttctcagaaatacattcgccttttccttcatggtcccaaggtggccccagctgctagaagtgccacggcttcacgttgcaacactcagggacatcaaggaagaggagcaaatccctgtcggcgtttccctttataagacaggaaaacatttccagaaggctccagcagagtatcgttgccatctcaccaaccagggttgcgtcacaagcccgtgccaaaccagtgatggaggatggcttgtgtagacagcagtcgcactaagcagaatcagcattgtgaagcgcaatcttaaagcaaccatatgtttatattatttgctatggcaactgggttggttgtctgagagttggaagctctgggtttctggaggacacagcatttatgagtacgaattcggatgcaaatgccttcatctgccttttgagtgttctctaaaaagtctaatttcctcggctatttaatgcacaataaaaatacagccaaatctgtactaggtctgtaaatggagagaacgtttgaaaataaatccccatgtaatccctaagtctcatttagccagtcatttcaactttcaccaccgctccactaacaaaaataaaataagataaccaaagaaaggaacaagaagtcccatggatagagttgtgtgtttatttctgtttccttgttgtgctttaacagaatagcatggacgtggtaaagtgaggaaacgccaggggtctctttgagctggtgatgggatacagcacgtgaagcttgttttgggtataaggaacctctgatgtgtgcttgcaacttgttatttcttgcatttaattgtaaaattctgaggctacgtgctgagagccagcctggcaggatgctgcccggggacggggacagaacgggagggattctcaggggcagctgtgggtttgggctgcgggggagccctggttcctgagctgaatcggggagagtcccagttcagaggagaatttatgacttggtcagaacccaggaacaatgcctcttcatgttatttatcttattttattagcagtgcacacgatcacgatcttagtgtgatctcattgtgatgttcatgttgttttgaagtgcttccttttttctcagtttataccgtttcaaataagagagtagaacttggtgagtctcggtttcccagcgttgccttatcttttcctgtgagcttttctgagctcttctgattggccatggcagcgccacacccctgcccgctggccagccaggagggctcctcagccagcttggggcttgcctggctcctccttcagacccctgcctgccctgcaaagagcagggatgctgccctcccctactaaccctgcccctccatctgcatggtaaatgccttatgctaagaattcctggagtctgttcatgccgcgtggctggtatgatgtcatatttccaaagccgacagctccctctactggcctggtctggagaactgcagtttgagtgccttgagtcagtcaatcttagacaacccaattctgtaacattttccaatttttagagcagtttgtgtttattgcctgttttttttagatggagttttgctcttgttgcccaggctggagtgcaatgatgtgatcttggctcactgcaatctccgcctcccgggttcaagtgattctcctgcctcagcctcctgagtagctgggattacaggtgcctgccactacgcccagccaattttttgtatttttagtagagacggggtttcaccatgttggccaggctggtatcgaactcctgatctcaggtcatccacccacttcggcctcccaaagtgctgggattacaggcgtgaaccattgcgctcggccagcccagctaatttttattttttgagatgggatcttgccatgttgcccaggcttgtatctaactcctaagctcaagtgatcctctagcctcagcctccctggcctcttcgggccttggcctctctgctgggattacaggcacgagccaccttgcccaccctgatactttcaataaataaacttttcccaaaggagtggtaggaatgtttcagccttttcatctaatgcatatttattgagcaccccagagcatgcagtcagttggaagttttaagcatgtgagctgggtaacgagggctgtggcggctgtgggaacccatatatgcatgggaacgtggacgatgagacaccgtgggtcaaggggcaccagggaagacctggagttggaagggatggctcatcaggtcaccaagtaaaaagaggaggcagaatattccaggtagagggactccttgtgcagaggccactagattagaggaagtgtggctcatgagtgaattacacggaatgctggctgtttgaccataaagtggattgggagggcattggcggtgagagctgagggtgaagaggtaaaaaccagctcattgaagagttgagacctcatctaaagagcagagcccatggagagtttcggatgagtagtggggatggtcagaggcccctgttggtgtcaccgtgctgctggtgtggagaatgaatgggggcagaagtgggacaaaggaggctagtcaggacaggagctgtggccccatggggacgtggtagcccaggtcagggatggagaaacaaagacagttttaggaaatttaaacttttttttgtagagatgaggtcttgccatgctgcctatgctggtctcaaattcccgtgctcaagtgatgtcagaggtgcagttggcagaatgtggtgattgcttgggtgagggaggatgtggagggcttgagactgagtccagccgtctggcttgggtgatggggtgactggtggtgttcatcactgaataagggatgtgggagaggagtagcttcggaggaaagatgttttgggtttgatgcattgagtttgtaggatacccatgatgaaatactcagtagacagatactcaggtaaaaaactgaagaaaagagatagaactggaaagagttgatgtggaagctttagagctgaaacttggatccacaggagtgtataggatcaccaaaggagagtgtatgagataaggagggggcttagcaggcagctgaggaacagcagcatttcaggaaggagagaacaggagctcagaatgttgagagggcggaaaatcagaagggtgagcatctgcatgtccatggaaagagcgtgtttcagaaaggatgaaagagaggagtgagtgggaaatgctggggagatgttgaatgtgatgagaactgacaaatcaccactgagtctcattgtaagaaggtcactggggactgctgggggtggtttcagcaaagtcagagagtgtcattagcaacagtgagagtagatggatctggaattggactgaagcggagttgaatggttgatggagggtggcgggaacatgaagacggcccacaggggttgctgtgagtcacatatgcttttaagatgagagacccttgagcatgcatgtcagctagttattgctgtgtaacaaacaactcccatgctctgggatgtttttattgcttatgcatctgtggatgggctggggatctgttgatctaaactgtccttgctcaagtctgtgggcaagtcggggacctgttcttgggcacttcggctggggcagctctgctgcatgcattactcatcctcttcctgggagcagcgagccagcctgggcatgctcttcttggggagacagctgaggcacaaacatgcatgaaagtctggataagtacatttcaaccttctgcttccatcacgcctgcaaacatcccatcggccaaggttccactagacagagaactgggaagtcacttaacaaagggcagtgtgaagaagatgggccattagtgcattgtaggaactaagggccttctgaaggttcactaaaatcaacttgcaaaaggcaggtgaataagagaagaggcatacaaaagaggccatgttcccataacatgcgtacatgggagccttcggaatgaaaacccaaaaatgcaggaggaattttccatttttctgcttaggttcaacaaagtgtggacagttatgtagaaatatagttggacaggccaggcacggtggctcatgcctagaatcccagcactttgggaggctgaggcaggagaatggcttgaacccaggaggctgaggttgcagtgagccaaggtcgcgccactgcactccagcctaggtgacagagtgagactgtgtcaaaaaaaaaaaaaaaagaagaagaaatataatgctaataaatagactgagtggggaaaccccacaggcctgcctgtctcctcgattcttctaggtttctctgagcagcacttcttccttctgggagtgactctccctggaacaggggtcttatgacctacagtcggacatggcaagtcagataatttctttatgttagggcagtatttttaggttttagggaacctttaggctggccttagggaaaaggggttctggtttcaaagatctgccttggggaagagggattccagtttggatggctggcctcagggaagaagggactgagacatgggagggcaggagggcagagagaaacctttgcttctgaggccttcactgtggggtattgctttctgagccccaacagcattctgagggaagtgggtctgcaaggaatgagaggttgatgagaaacaggagggatctgataaatattccacagcagtgggcagggagtggctgtcaagcacaggaggggaggagcagggataagcctccttcagcaagaggagaatcccctgcgttttcaataggaaaagtgaactgaggattgacgaggttcataaacttggaaagaagagctttcttctcataaagggttgcagcctgcagggtggctattgtggcagggaagcagcgcctctggccagaagccagaaacagacccttccaggggcagaagaacaagacagaagaacaatgcatgctgaaggaggtggctcaatacacatattccataagctatgggagaagcattgaatatcgatgagaggagaaacacgcaagtgtgcaatcgagctccgtgcctctccctgggacctgtgttcaaaaagcaacagcgttagcatgatctgagggtggagttttcaggccctgacctcaaaaggtgaagcagaggacatgaaaaccctcactgcgcgtcctctgtggacctgccggacgcactccaaagccatggccagtgtctctcatgaggacggaatgctggtcggttgtttcatccaaattgcagaacggcggggcagcatcaggcggttggtttatatcagtggaggagtctttagaacgggctggtttctgtttagacttaggaaagaaagcctcacggttagcaaggaatgggtataacgaggcgcattgcccttccatcctgtcatagccaggactcagttttcaagggttctctggggtccccttgggcaggagggggtcggttcagtccgttggatggctcaggatttcacttttccttctcggaggcccgtgaatgtgggcagcgtggggggcgatgggggaaagccgagggacttcccttctggtggtttctgttccctctatgaacttgaagatgagtcatccaggagaggggtttgcgtgaggtcggtgacttccatgtgaaaaatttaacattttccccatggggcctggggaagagtcaaccgggaagcacaggagcactgctggggcaggctgagaagccggtcgggcccgggtggcgtgggtgtccacctctttgtgtcccccaacgaaggcaccttcgcatccatgcagagcggaaccaggggtgtggcggggccaggcgtcatttccagctttcctcttttgcataccacagacctgtccatccactcatttaggagctctctgaatcaagcactcctctccctcctcctgcccggggttgggggctgggctccatctctgcctcctgaatgctcccgtggcttcctggtgagctccccaccactgggagagcctcaggtccagggtggagaggccccacaccaggccgcacagccagctgtgaatcatggtcctgaccttgcactctttttgaacggctctatgctagtttccccttttttatttttatttttatttatgtatttattttgagacagtgtcttgctctgttgcccaggctggagtacagtggcatgatctctgctcactgcaacctcctcctcctggtttcaagtgattctcctgcctcagcctcccgagtagctgggattacaggcacccgccaccactcccagctaatttttctatttttagtagagatggggtttccccatgttggccaggctggtcttgaactcctgacctcaggtgatccacccccctcagcctcccaaagtgctaggattacaggcgtgagccaccatgcccagccagttctcctctttttttttttttttttctttttgagatggggtcttgctctgtcaccaggctggagtgcagtgatgcaatcttggctcaccgcaacctccacctcctgggttcaagcaattctcctgcctcagcctccggagtaactgggactacaggtgcacgccaccacgcccagctaatttttatatttttagtagagatggggtttcaccatgttggccaggacggtgtgatctcttggccacgtgatccacccgcctcggcctcccagagtgctgggattacaggcgtgcgccactgcgccaagcctatctcctctttttttaaaataaacttttgatttgagaatagtttatgtttacagagaaaccacaaacactgtacagagaatgcctgtgtgcctcacactggttccctctgttgttaagatctgacgtccgtgacgcgctgaacacaatgaatggacgcgtgtcaattcaccattattaactgaagtccgttctttattcggatttcctcagcgtttcccggatttcctttttctgttgcaggatcgcatgtggcatttagcactcatggctcctcaggctcctcttggctgtgagcttctcagacttctcttgtttttcatgacctcgacagttttgaggaggactggtcaggtacattgcagaatgttccttaatttggacgtgcctgatgcttttcttgtgatgagactggagttatgagtttttggaggaagacgcccgataaagggctgatgggccttggtcacctggctgaggtcatgttagcagatttctccactgtgaggttctctccctcctcccccgtttccgtgtaatagtctttcacaggaagtcagtgcacgcagcccgcgggttaaggaggggggaacacgttctagccccttgagagtggagtgcctgcctggattattcagaatttttcttccagatttttctattctgctgggcaccttttacacacagattgtctcctataattttcacaaatgggaggttgatattatccctcattttacagatatggaaaagctgacttccaaaagacacccggattctgagtggcaggcctgggccttgaacctggctgttctcagagccagctctcttcagtactgagctcattgtctacactatgttccagtgacgcgatttcattcaaattcacttcctccctgggtcacttgtgaccctctcttaagcagggtagggcttattggtggagagggggtgttctggggttctctaggtgaacctaccctttaaaagggcttctctgaggatttcaggaaccaagtccgattccataatgtccaagttggactgggctcaaactagatttttttcttttttttttttgagacagggtctcactctgtcgtccaggctggagttcagtggtgtgatcttagctcactgcaacctccacctcctgggttcaagcaatgctcctgcctcaacctcctgagtagctgagaatataggcatgcaccagcacacccagctaatttttgtatttttagtagagacaggcactatgttgcccaggccggtcttgaactcctggcctcaagtgatctgcctgccttggcctcccaaagtgctgggattacaggagtgagccactgcacctggcctcaaactagatttcaatatggcgtgtgtttgggttcccttgtgcaaggaaggctgtgtgtctcatatatgtaaagaaaaggaaagctccttttggttactcatcatggtttttaaagaagaaaggttaatacttatacattcttagaagtattgggtccacctttgatttccattgaatggggtcatctgtgtgatgagaggtattattctgccatcctgggaaaacccgtgggaagcagggcgtgatttcttggatcatcgaaagctcaggcctgtagtcagaacaagttgactgcatgttggtttttctggactcaacataatacgcagaacagatctatataatgggtggtttgctctgtggactttgagtttttcctctttccacctgttcaaagtgctgaggatatatcagtgcaaaggaacatcctgcagaagattgtgacggacacgctatttcacagtttaaagaaatggctccaaaggaattgcaattcattttactatgcccctggttaaatctaactgacaggtgccgccaagcatttaactggaccataaaccaaactgagatcaaaggattcccccaccttcccataccacccagttgagagtaattcagcagctctgggtacctgacagctggccttagcccctccccgcacatagtaaaggacgagggagagcaatgtggtgtaaatgagtcaaaaaagcaccagcgactggctgtgagtcacgcagcgaggggatcgtaccctttgtttcctgcttataacctgaacactgttagactcatcagggcttccttttcaaaaagatacatggttccccttttcacatttgtggagagctcaggagatgggctgaggtcaatggcgagcttgctcctcaggagagttcacccctgattttggttgcctgttccttcttcttttggattgatgaagagcaaacccacaggatttcatactggtgaggcagcagcctggagtggccctcaaaggaggaaactgggttccaaccccggcagtactatccctcagggtgtggctggggagacagaagccacttgatatatcggagggtttcatattggatttgctgaactgaaggggctaggggagcagaggccaagggcgcccagccctgcctactggagatctcagccgcagcggggaatcctggaggctgctgcagcgtcatgctcacgtagtattctgtctgcagaggtgggctgggctggggaggcacctcaggtctcatgcctgcccgaccccagagtgatgtccttgccacctctctcccatcccaaatctcaggcagtgccacccattggaagtttctgtgcaaaccagatgcctgtggagattctgggcccagggcccggcttctccatgattcaggtgttcctggggggagggaggtgatgccaagttaaggagagagtgcatagaaatgtccacgaggcccctgcagctgcgacagtgggggctgaaaggaacatgcttgagttggaatgaataagtggggatttctgagcactgcgtcatcggtgcataagaatggggactgtggccagacacagtggctcacacctggaatcccagcactttgggaggctgaggcaggagaactgcttgaatgcaggagtttgagaccagcctcggcaacgttgggagatcccatctctacaaaaaaaaattttttttaattagctgggcatgatgatgctcgcctgtgagcccagctacttgggaggctgaggagggaggatctcttgagcccaggaggtccacactacagtgagctatgatcgtgctcctgcactccagtgtgagtgacaaagagagactccatctcttaaataaacaaaaaggatgggaactgggtacccagcacctcccctggggttcaggaggagagactcgggcagattgctcatattcccaagagtttcagacctcatcagcaggggcctggatggaggtggcagctcaggggagggtgcagcagagggagagaggaaggaagctctttccaccaggtgtggttggtcacgaaggagtgaagtctgagcttcggggacagtggttctcacctggggtgttcttgccccaccgatggcggtttggtggtgtctggacacagttttggttgtcacaacctatgcgggagtgggggtggttgctactggcatctatcgggtagagaccagggatctgcctagtgtcctgcagtgcacagggcagtccccacaaccaagagtcatgcggccccctgtgccgactgtgccaaggctgggacggaccctgctccaggacactgaagtgggggagggggagatgtattcacacaaggacttatgagctagccggcatcaggtggcatggacagttgacccaagaggatgctctcccactccattttggttttccatgggagaatcctggaaacagcactgttgctgtgacattctccttattcaccattaactgagagcaccatgggcgtgcctgggaatgagcagaaagttagatcctttttggaggtgcaaggtgagaaaggggagaaatctgtgttctctgagacatctccttacctgctttgctttatagctgagggccttgcctgcgacactctgtgggatgtgtgtgggcgtaggtagttagacacacacacacacacacacacacacacacacacacacggcggcggggggaggggtggtggtgggtaagggtggagagagagactcctgcttctgggtgggaacagggtgccagcgtgaattggcactgtcctattgctatgatgatgactttttcctccctgcagctctggagcacttggaagcggttctgaagctcatttgcagctttgcatctgtttgcacgggcgtctcctgctgggagttgaggcttcctgccctcattggctgtctgaggctgcgctccctacctgcccgcagcgtccctgccccccacatccacccccagtagtgtaatgggacagctcctccctcgagtgctttgccgaaggggacctgcaagaacccaaaacagcagcgctgcagccagggcggtgccttctcctttcctctgtttcctgggctccaggagaattctgtcttggggtccgagaaaaactcacacagcagaccggctggcccagggctgactcagtgtttctttctctctctaggaaggcctggctggaaccagcacattttgtggaagtgggaaccaatacacgtgtacacttctctttacagggcacgctatcatcactaactacttgttgaactatttccctggtcttgaccttgaaaggaggaacgcgttcgggttcaccgccctgatgaaagccgccatgcagggtcgaacggactgcatccgagccctgatgctagcaggtatgtccacctgtcctgtgcagcttccaggggccctgggacaccagagttgctcctttatggaatatgttttgagattaatcactcccatagaaacaatgcctagttgctgcaataaataatagtttcttcactgacatatacttctgtaactatctgaggttttaaaaaagccacagcattggttcccttcaggacacccctttctgctccctgctgagctttgcagtgggtggcaccttccctcacctgctgttttcctcctgcccacccgttctacaccccaagtcctgtccatatctgttcctcctcagaaaggggtgatcccttggctgtaaatggcaagactgtgctgttgaaggtgggcgtagggatggtgggaacggcccaggccatcctaggtcactgcttgctggtgggtggcattgcatagtaacgttaggaggtgatgtggagttgcatgttaatgttgggatgtgatgtggagttgcatggtaacgttgggaggtgacgtggagttgcatggtgacgttaggaggtgacgtgttgcatggtaacgttagaaggcgatgtggagttgcttgttaacgttaggaggcgacatgttgcacggtagcattaggaagtaacatggagttgcagggtaatgttaggaggtgatccggagttacatggtaacattaagaggcaatgtggagttgcatggtaatgttagcgggtgacgtggagttgtgtggtaatgttagcgggtgacgcggagttgcgcggcgatattagcgggtgacgcggagttgcacggcgatgttagcgggtgacgcggagttgcgcggcgatgttaggcggtgacgcggagttgcgcggcgatgttagcgggtgacgcggagttgcgcggcgatgttagcgggtgacgcggagttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgcgcggcgatgttagcgggtgacgtggggttgcgcggcgatgttaggcggtgacgtggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgcggggttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgcgcggcgatgttaggcggtgacgtggagttgcgcggcgatgttagcgggtgacgcggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgtgcggcgatgttagcgggtgacgtggggttgcgcggcgatgttaggcggtgacgtggagttgcgcggtgatgttagcgggtgacgcggagttgcgcggcgatgttagcgggtgacgtggagttgcgcggcgatgttagcgggtgacgtggagttgcacggtgatgttaggcggtgacgtggagttgcgtggtaatgttagcgggtgacgtggagttgcgcggtgatgttagcgggtgacgtggagttgtgtggtgatgttagcgggtgatgtggagttgcgtggtaatgttaggaggcaacgtggtattgcatggtgatgtgtgtggcaatttccgttttctatgctgtgtcatagagtggaaaattctcaggctatcaacctggatcaacccctctttgtcttttgcgccatcttggagaacgcactttcctgttcccatctgtgaaatgggagtaatgacctctttctccctcacctccctgaggctaaaatgcaacaatactttatacactcctagaggctatccagcttcaatgagctactaagctaaatgccacacaactaatagctttaactcttttcttcactctgaaatagaatcaatgatcatccttcgtgcaacctcatcgggttattttgagaattaaatgagaaaatatgtgtcaagcacatgtcgtgttagattcagttagcagctgacatctcagtgaatgtgcgatgctgctttcaccattacttaattctgttattttaatttctctttatttttgttcttggcactgggttcagccagtcctgcttggcgctgcaagttcctgaagaagtggatttcctctctgtcttagttgttctgctgctataacaaaatacctcacctgtgtaatttgtaactgtagaaatttattgctcacacttggggaggctgagaagtccaagatcaaggtgccggcaggttcgatgtctgctgatgccccttccttcttactgtctcctctcatggcagaggggacaccgaggtaccctcaaaccctctttcataaggcactagtttgattcaggagggcacagccctcatgatctaatcaccccctaaaggcctcacctcttaatactattccagtgggtctgaagttccagcataggaattttggagggtcgtcaacattcagaccacagcaccacccctgtcttggttatcctgagggtggcatcagagttttcccaggcatcagtgcttccattaatgtcacttttctgttccaggacccctgctgggctcccacatttagttgtcttcttcttagttgtccccagtcttcttcttcttcttctttttttttttttttttttttttgagacagtctcactctgtcgcccaggctggagtgcggtggtgcaatctcggctcactgcaacctccacctcccgggttcaagcgattctcctgcctcagcctcccgagtagctgggattacaggcacctgccaccacgcacagctaatttttgtatttttagtagagacggtgtttcaccatgttggccaggttggtcttgaactcctgacatcccgtgatctgcccgccttagcctcccaaagttctgggattataggtgtgagccaccgcgccctgcccctcatcttcttgggtctgtgaagtttctgtcataacctgttgcccatgacgggacagtcttgattccaaccagtgtgcagcaccgcccagtctgagcccgtctgttgtttttctcgagatcaatctggagttacaggattcacaattgcttcagatttatctttctttttgctttaaccttaggggattctttagtcttaggagatgctataataaaaataagttcagtgaatgagaatagaggcttcaaagatgaaaactttcttggaaataaaaaaaaaaacataattaaaaacgagtcctatcgattgtacttttgattcagagatgatagttttattttaaaaaaacgagatatcagtttcaacagagtttcggccctgcctgccctcatcaatgagaaatggttcctactaattaaatggtaattatgtgatgcttttgtgtttggcgggagcttcagacacttttactatttctggatctagttataattgggcgtagatgtttggtaattgactttttcaactgaacatttatgatgtcagtcacatcactgcactttcccattgaattaatttgaactgcaaaccttttttaggtcagttgccctctaatcgctccgtttgactgccgtgctttcttccctgggtctcctgggggtttcaggcatgtgtgacagcatttagaggattccagaaacaccttgcacatctcttggaacgatgagtctgcgggcagtgggtttactgctgacattgctcttcccccatcagttatttggatacaaatttgacattagatttgagactctccctcccctattctccactttgcaagcccatcccccatcacagtctagaacaatccacggattattgtctgtgggatcctctagtgagtctctccctgtcctatacgaggtacagagcaggagctgaacagaaacagtccaggaaccaggacccagtttcaaattcatcttctccacttcccatctctacacctgcagcctgtcactcacctctctgggccccagtttcctcttctataaaatgaggctaatgatagcacccaccgcaggaaggtgggatgcggattgggcacgttcacaacagaacagccctcgggtgcatgctgggcttggagaagccttcggacatgttggttgtgattattgttattattatgattattggtgagtttatgtgttcaatagttatctgttaagtgaatgaaaaaatacggtttgtttttccctttgagaaatatcttgtaaatgagatacttaaactttcttaatgagggtagtaagcccctacctcagggtttttgttttttgcttttttgttctgtttttgtttgtttgttttgctttgttttgttttgttttgagacggagtctcactctgtcgcccagagtggagtgcagtggcgcgatctcggttcactgcaatctctgcctcctgggttcaagcaattctcttgcttcagcctcctgagtagctaggactacaggcatgcaccaccacatccagctaatgtttgtatttttaggagagacagggtttctccatattggccaggctggtctcaaactcctgaccttgtgatctgcatgcctcgtcctcccaaagtgctgggattacaggtgtgagccaccgcacctggccaggggtttcttaatttcagcactactaacatgcagagccagataattctttgttgtgggggctgtctttcaaattgtaggatttttagtggcatccctggcctctacccacaagatgactgtagcacctcttcagttgtgacaaccaaaaatgtctctagatgttgctcaaagtctcccaggttgggggaaaaattgcttcccatcgagaaccactgatataaataatttaaatgggaaaggatatacaaagtgagaagagacattttcccctctgtgtactcttcctcgcttgttctgtattcctccctcaaataaaagtgtgacatcttggccgggcatggtggcccacgtctgtaatctcagcactgtgggaggctgaggcgggtggatcacctgaggacaggagttcgagaccagcctggccaacatggtgaaatcccgcctctactgaaaatacaaaaaaaatttagccgggcatggtagcacaagcctgtaatcccagccactcgggaggctgaggcaagagaatcgcttgaacctaggaggcggaggttgcagtgagccgatatcatgccactgtattccagcctaggcaacagagtgagactctgtctcaaaaaaaaaaaaaaaaaaaaaagagaagtgacatcttgtttagggaacttttgagctgccctcttaagctttggttgtagtgtagaacttacggaatattttcatcttctactattactactaagcttacagttctcccaagaaaagtgggttttattttcctttgacagtagatgggtaagaattaaaaaaaaaaaaaaaagtgttgaattgcttccccaggattagtggagagcaataaggacagatgttgatatatttctaaaattcacacaaatattttaagtcttattctttccatttaaatacgtgatattaagaaaaaaataaaccatttaaagaaactaatagccagagcctttcttttagattgacacttcagattgtaataaaaagtataaccgggttctgagaggctgatcgattgcatctttggtttggcttcgtaaggagtaatgcaggctctgctgaagagcatcacaagggagttgcagaaccttgttaattcactgaaatattaatgcccacagtgacaggtctatttaaataggtggctctgagaagcgtatcgaggatgtgatttttttctgaagagaggcagaatctgtggaggttgccaggttccaggcttgcttaagggagctcactttcagacctgaagtgtggtgtaactgccgcagccttcaggaagcaaaaacaagcagcaataacctcaaatcttcctgtgattccaaggcgcaaagtggatttaaaggacggcgaggaacagagatcagagatgctcccgctgtgggtcagagggttgctcttgtctcagggaagccctgatatctctttctggaaagtcagatgatttccaaccatatagaggtttctttctgtttataaggaaaacttaaatttcctatgaagtgtgaatttgccatgtagaattgtttgaagtcattagccagagaaaggatgaaaagtcaagcattctgtgtcacctgcaaagcaaacctcgagacaaggacttgggggcaagtagttttgagggatggtggccccaggaagtggagtgagggggcagcaagtgagattgggaagaatggaagctaagaaatgtccaccaatgagcaggttcctcttgtgggcagctgggactcagaccccctggaccctccactatgaggaaaagatatcgcagagatgctgggaagtttatttcccaactccagtgcctctttgaggggagatgagaactttgagcacacttcccacctgctatgtggtgggggtggcttgtcctccctgctgggctggagcacaagctctttcttggaccctgcatccagatttgtcatcccgattatacccacaatgcccaagatacaggctggaggtggcacaaggggaggcagtgagggctggtccacagtggtctcctgtggccaggaaaggccccctggcaagagggagacctgagctagggtttgtagagtggataacatgggggtgggtgggggctggtggagaagcaggaaaggaagtgacacattcagggcttcacgctccacccacctcctgctagtcctgggcctggccatggctcccagagaaagccttcttgagaatgagtgatggaaagtatagatttttttttcccattagcacctgtttggaatgtttttggctgcaagtaacagaaatcctgactagacagtggcttaaagaaaacaggccgcatttctcagctccctggaagtctgaggttggcagtcaccctccagagctggccctggattccatgaggacaacagtggtttcctcctgtccatttggctccccttagcctgttgatctgtcaccccttgattccacgagaatcacccaatatgtgtttcagacaggaagctgcagcagcaccaaccatgctggtccctttcgtcaggaggcagaaccctctttagggctcagtcaccagtgctgggttgcttggctacttttagctgtaagggaggctggaagaatggggaacaggattgcagccgttagattccaatagtgattctcagctggaggtaatgttgccccaggggacatttggccacgtctgtagacatttttggttgtcagaactggcggactgctactggcatctagaagaaggtagagatcagggatgccgttaaatgttctccaatgcacaggacagcccacaccaaataattacctggcctaatatgtcaacagtgctgaggttcagaagtcctgggttagactgatcgtgatgcattgccaagaactgaggatgttgctgcctcaagtgaaatagaggattttgtgtagacttagagcactcaacaaggcagcgagtggacccatgggtggcagctccacttttgtccacatgattgagccctgggcaaaacaacactgggtgggagatgacgatgctggggggtctgctggcgagaagatggatacagtggcatttcagaaatcctctgtattctctggaaggtatttgtataaaatgttaataatcggtacttatcttttataatttaattgctgtgttcatgtcattaatataaccctttacagttgcttcctaaggcagcagatccctaatttatagcatgactctgattctagggctcagtggcctttgttccttagaatgtttgtattttctgagatcattttgaaaagataggtgaacatcaggacgaagagtgcaaaactttggacagatcttcctctggttttccattagcatttgaaaaatgtctctttcaggcagtgttcattaagattttaattttatagtttgttccttttttaagtgacatgcaattaattaaggtttaatgtgtcatctattttttgcaatgacacttttactgcccccttttcattttagtcagtttataaattgtactctagctaatgagttccatcctgatatccagttccaaataattaccactcttctaatatggctattctttaatgtgtcacagaactaagatccttaccaggcaagctcaggtgagctgggtctgccagagccatgaggccactgtgggccaacaggccagggcagtggctggggacccgaccttcctcagttcagcacacgttgatcagccatcacatgtcagactcctgggtctgcatgggatataaatgaagaagcgtctgtcgggtccggtcccctttgagctcacagactagataattgccctagttctccatgttgctttgctggtggagatatgactaatgggacttgaaatcctcaatgatttttttttttttgaaatggagtctttctctgttaatcaggctggagtgcggtggtgcgatctcggctcactgcaacctctgcctcccgggttgaagcgattctcctgcctcagcctcctgagtagttgggattacaggtgcctgccaccacgcccagctaattttttgtgtgtttttagtagaggtggggtttcaccatgtattggccaggttggtcccaaacccctgacgtcaggagatctgccctcctcggcctccaaagtgctaggattacaggtgtgagccactatgcctggcccctcaatgatttttaacagtatgtgggactgagattggaccaagattaattgaacagcaattccgtattaatttctatactacaacattgaaatttatgcagatttcatcaagttgagttgaagtttaactttgcaatatttgggggcagtgggtggactggggagatttattaagggagtgactagtgtcagggagactgtgtaaggggacctatcagtcaaccaataggatgtggatatcaagagatttattttaaggaattggctgtgtggtttggggggttggtgagtctgaaactggtgcggtaggctcgaaggctggaaactcaggcagcagtaagtagatgccgcagtcttgaggtggaatttctttgtttccaggaaaccttggtctttgctcttaatgccctcaactaattgggcgaggcccacccgcattatgaagggtaatctccttgacttagagtcaactgattatagatgttaaccacagctgcaaaatacctttggggcaacacttagatccatgtttgattaaatcactgggtattctagcctagccaagttgacatagaaaactaaaactgaccatcacaccaggactgccaggtggtaggaagtacattagactgaggttaggacacccaagtcttagaccctctctctgttactagcccacagccactgtgactgccattctttttgcaacaagccttttaaaaattcatgccccctacccaccaggatgaaacgtgttgagcaaacaaaaatgaatttttctatcctggaaaagcccaccatcggttaaaggtagacagaccccagccagctaggccgcagtgggagaagcgaaggaaccacccatttcccacagtccaggacccatggcagtcctcaagagtgagaccacagctggggtgccaccactttgcaagtgactgttactggtcatatttttagaactttctagccacagcattcaagtatgcaaggcagctttgttgtctggtcatctctccattgatggaaagctataggatcttatttctttaaaaaattctgtaatttggccaggcgcagtggctcacgcctgtaatcccagcactttgggaggccgaggcgggtggatcacctgaggttgggagttcgagactagcctgaccaacatggagaaaccccctctctactaaaaatacaaaattagcctggcgtggtagcacatgcctgtaatcccagctactcgggaggctgaggcaggagagtcgcttgaacccgggaggcagaggttgcggtgaacggagattgtgccattgcactccagcctgggcaacaagagtgaaattctgtctcgaaaaaaaaaattctgtaatttaggtgctgaattcaggcggggttttattcaggacagataatcaatggagcacttaaaaggcaggttgggctgggcacggtggctcacgcccgtaatcccagcactttggaaggcggaggtgggaggattgcttgaacccagcagttcgaaaccagcctgggccacatagccaggccccatctctacagaaaattacctgggcggtggtgtagccccagctactcgggaggctgacttggggggatggcttgagccccggaagtcgaggctacagtaggacgtgttcccgccactgcactccaggcccgccttccggcgctcagatgagcacagggttcgcagagtgaactaggtgcagtctgttaggaggcttggggccaggggtggggggtgggggcagttttgcctttgccccaggctctgcctgggagggaagagtccttgttgccgccacccacttctgtttgtgttttgcgttttgcaggggcggatgtccacgcgagggacccccgccgtgggatgtcgccgcaggagtgggccacttacacgggccgcgtggatgccgtccgtctcatgcagaggctgctggagcgcccctgcccggagcagttctgggagaagtaccggcccgagctgccgccgccccctgaagcggcgcggaagcccgcgggctccaagaactgcctgcagaggctcacagactgcgtgctgtccgtgctgacgccgcgctccgtgcggggcccggaggacgggggcgtcctggaccacatggtccggatgaccacgagcctctacagccccgccgtggccatcgtgtgccagaccgtgtgccctgagagccctccgagcgtggggaagaggcggctggcggtgcaggagatcctggcggcgcgggctgcacggggcccccaggcgcaggaggaggatgaggtggggggcgcggggcagcgcgggcggaccggacaggaggacgcggactcccgggagggctccccgagagccggcctccctcccgccctggggtcccggggccccgcagcgcccgccccgcggaaggccagcctcctgcccctgcagcgcctgcggcggagaagcgtgcggcccggtgtggtggtgccccgggtccgagtcagcaaggcgcccgcgcccaccttccagcccgagcggccggcgcggaagggcagcaccaaggacagcggccacctgcagatccccaagtggcggtacaaggaggccaaggaggagaagaggaaggcagaggaggccgaaaagaagcgccaggccgaggcgcagaaggagaggcgcactgcgccctggaagaagaggacgtgagggcccgtgtgcctggcgctggggccggggctggggccggggcggggccgcagggctgggcgcggagaaggaggcggccccgttgcgcatcgcaccacttccgctccatggaccacggggctgcgcgcatttccaggctgtttgtccaggctgcttccaagagagggctgagggagccacatggattcgcttgtcgccagccctcctagcaatcagtacacctagcgggcacgttgcctaaaaggctccctttagagaacctcaattaagattttttttaaagatcaatttatcaaagggcgttttctccgtaattttgtatttttaatcattatttatcaaatttgcaacgttttacaagtgatagggccccttatatccaaggcagttttaatacacttgcctgaagaccttttgtttaagatactgtttctagcaataagtatccatgatacctgtatgagttcacacagacatcatgggattctcccctttttggctgtttggtcttttctcctcatcgtgggtgtaggtgcacactggatgttcttagtcattagattaagtgttgccggatatttctatttgacggaggcattggctcgttgagccacatgatcaagtgagacagaggatcagatgttactgtatctttttaaaactcttatccatatagtaatatattgaggaaaaacatattgtcaaattataaaacaatggagcgataaacatgtatttattgctagaattaaactcattttaagcaaggggttttaggtaaactggatacgaaatctttaacattaaaaatagatatgagaaaaaaactgtcattcgataaaatgaggcaaatttaataataaatgattaccagaaatacaaaattaagccatatgtgctcttaagtaattcgaatccagatatccttaaaatgtcaaaaagatgcaacaagagtcaggagcccagaatgacgcaaattacaggaatggggaggaggtgatttttagaagaggtgagagaatggaatggggaacagacttgttttcggcaaattctcctggagtagactgggcagccccctcctccaggctcagttccaaagagtccgttgtgtggatatttcttttatttttcctttgaggactgcgcttggtgtttagttcatccttatgccgacctcttagaatttccaagatgcagggccttgggcagggcagggcatgggtgtgatttgccttgggccacaagctcttggtgagagtcttatgtccacacttttatctccaaagtgacatggagatcacttttctcagtgatcaaatttgaatttatcaaagggggttttctgcataattttgtatttgtaatcattatcagatttgcagcattctaattcggcagggcagggtatgaaagctggaaactcaggctggagtttctagttctaatggctctctggccatgtgggttgtagagtgtctgtcacatatgcactttatttcagtattaattgaaatacttggacacgcacgatcacaggcctatttggaggctctgtactatgaccctaataaccctagatacatcatgatacatggtgtctgtctcaggatgcaggcagggctggtgcaggcttctccatactcccttccacttggcaccagcaggcatcgagcaaccagggatcttaaactggcctctccaaatactccattgaacaggactgcaggctgcacccaggctaatgggagattggtgtgttgatgatacagtgtttaagatgagattgcagtgagttcctccttaatcccagaagggcaccatgatgaatgccacaggagactggaccctctttgagaactgcagatattagttgactgtgggtcaccctcgtggccaaggagttgggattggccatgtcttcttcgaggaggtggagactgtaactgacactggttatctttggggttgtctttcctgaatcctttggcatgtggcaccttcctgccacatgtagataattcacggcattaccaagtcaccacgagccccaccctcacctctgtcaaccgaggacccagccaggcagtgccatgtggtctcccaggcacgcttctcaacaccggctacccctgctgtgaaggttctcaaggccctggtccggggagccaagccctgggagcgccctaaagctccgcaggtaactgcactgcagcccgcattgagaaccgcagctctaacacagtgattgcgagaggacacccattctgagctcccacagagggctccacctccccaagaatgtctcattgtcattggaacagccagggtcaggcagcttctgctcggactgacgtggcgtctgacccttggtgggttgccagacattcctgcctgtttccaccatgggaagctgtcactgggaatggtatggagccctcacttctaccccaagcctgggtgtctgctgcctccatgtcaaaaatggacatttctggtcctgcccagctgctacctcaccacaacccatgctcagagttgtcagggatgcgtggaacagcaatgatgggacagcaaatgactggcaatttccccaggtcccacgctgttctggagtggacgtgttgcggccctgcccccgatgtgttccagcctcatccaggtgcacaggatactctggggccagcacagggattgtccagtgatgctcctggtgtccacaaaacagctctagagatacctgcattttgaaaagcctgctgagccaacaagcttggggcaggacacggatttctttggcaaatctgcaggcgagctgaccacttgcctggtgagtggaagctgccattacctggccagtgtttgcaactcgagggaaaatgacagctgcatggggggaagcctgacctcccggggagctttattgtggcctcagtggaaagattggattttgaaacctgccagacccaactgaaagaagggtcattcctgattgagttggagactctccccagtccctctctctggactcattctagctgtggcctgcctgtggacagcccttccctttggcccatgcggcgggtccaggcagctcctgcagctgtgctcatggctgctggcccagaacttctcatttttgccatgtggaagcagatttgctagtagaggaattttccaagtcaagggaagtgttgccaaacctcttgcctcgacctgtggggggccttctgctcttgttttctcattctctttggagtgggcacagaggggacaagtcggcccccagtgaggctcagggagtgcaggagaccagggagggaagcccagatgatggggaaacagagccaccttgagggggtgtcatggggtcagtgtcagggtgatctgacgggtcagttcatacttaagcaacattattctgttcgtttcttttgggtaaggaattcctcatgggaggtgtggtcatctggtcgtagaggtggacagaaacaccccctcgtcttcctgagccatttggaagccctttcctctagccctaggtactggtgacacaggcccctcggtctcaggatgtggacagggctgggaggtgcaggcttcttgtcccatccccactcagtatcatcgggtatctggtagtcaggggtctcacagtggcctctccaaaagcctggtgtccttggagaacatttttcattttgtctgttttcgttgctttgaacagctgcattcactcaccgagggctcgccctccctggatctgccatgtggttcagggaggaggggaccgatgagcaccgaccccttctcttcacctgtcagtggccaccacagtgccccctctggctttgccaccacgttctcctgcccccgtcaccttgtctcttctaactcattagcctttccttcctttgtctgttttcttctcccagctggtttaagttcttgatcatccctggcaccacctaccctaaggtcttccaagaacagaaaagccagggcctgtgtggggcaatgtgttgtccctgtcgggttatggtgggacctcctagaccccagagtgaatgaatggcaggcctgccagtgactgtgctgatggcttagaattcctacacggctgtgcctctcccaccccgtcctctttgctcggaagggagacctggtttgctctcctccatgacagcccagcccctgctgtgcacaggggtggggctcgggatccctccctgcaccctgatgtttattaactgtagatagtgaatttcaagttgacaggtaccttctcagggatttatatataaatatagttagaggaaaagttgaagtctattttactactttttagtgtttgagtaaattatgctttaactggacagaagaaatatttctcagacaatgtcgatgctgctgatgacaactgagatgcctggagctcacccttgatggagacttccttggtgattggagatgggggactctggtggcagaaatggctttggggtaggtgtgaagttgcttcagtccctctgagttgcctcttctggatggaacgtgtgtatcaacaacaatgaaatgcacctccgtgtgcatggaggcggctgatgagaatacagataggccagtcctcgctcttccctccagaaccggccgctcccggtctgacgttggagcacgtgaactaagagtgacaattttttctacttgcttctgtgaataaagtgttctacagtcagcccagcactaaactcaccagaaaagaggagggaacagcacggagccattcatctggaattactcgatgtgcagaggctgccccttggccgcacttgggaacatcgtggacatcttccttcctctcaggctcctcctgacagactcctggcagcactggagacctcaggactatggagatcagaattgtaatggctttgtcatctcagtgtggccactcctgaggcaagaggctcctcctgggagcaggagagagagagtttgtgatgttggttggaaaataggatttatggatgcaggagggccgtgctaggcccctctgcccgcttctctccctgctgttggcggtgaccaggtctcaggagcggagacgaggctgttgtgagtgaaacagaagcccctggcatagggccagaccctaggcctgaaaaggatgcaaagcctgctgttttcaggctgttgggaagaatcgtgcgtaccgagtgattatgatgaaacgtatcccagagaggaaatgaatgggacctgaaaagtgggtctgccacatccctggtagcccgcctccaagagcactacactccccccagccccaccggccacactacatgacgtgggaaggctgtccgttcatccttaccctggggactcaagtgtgctctgcggagtgagtcacagccctgatgtgcaccctgcactactctttccccaggtgcgccggagacgcaggcttgctcatttccgtcctgacacagctcgctgttcctgcggtggtcagagtccccctgtgctgtgtcagctcctggacactactagtctttcacatgataaagcgcgagcactttttcgcttttgcagtatttggggaaattctaacacatttcccggggatttgcccaggtccctccacctcccacggtgggtaactgtgtggattctgcacctggcaatcggcgctcccctttggaaacacctgggggccctgtttcttccagcctggtccttggtttctaccccagccgctttcagccggcacctgcatgggactgcctggagggccacggtccagggaaggacaggtgggaccctgaccatgacagatctttctaaaacaataaagtcccattgatgacaactgcagtgggatgaatgccattgcagcggtcatgctgggagctgccgagagcttacaacaaaagcagttcctctcaagacactgcttgcatcttccctccacgcctctcggtgcatttggaacttgtttatgcgctggtataactcgagtcagctgcttatttctgtgcccttgcactcacaggttccttcattaacattttaaataagtggctaaaaaaactcctctggaggttgtttttgaaagagacaggaaaaagaaacacacagtacctggattgttttgacttattttcaagcgactcagctgaaagccggtgttgcatacacaatttcctcacgctgacccagcctgactaagacttgataaaaggcacagcccttggcagcaggcagtgccaatgtggacagtgtacactaagctgtgagtgtgtgcacgggcgagcacatgtatgtgtactcatacatccagatgaactaaagggacactgggctttgtgctggcaaaggttacgatgctgctgtagcttggctgtgggccccaggcagtgtcagatggaacctgctttgatggcgtgttgttcagtgtactcagtggggtctcacatggcccgaggacccactgtgagcactccgcccgctgtggcacagaacacggctggggtcatcacagcccaggtctttattgaaaggcggctcatatagaacccatttggccaggtctgggccatctctctgcctctgccctatcttggctgcctggaggggcccaggcccaagaggattctttacccctggaagagctccccaggcattcagcctatggcccttgacatttggctgcaggttaccgtcagaatcaacaccatatcctgaggaagccctggtatttccccaagtctgcctatgtattagacactctaatcaatgctaacacagttcagtttttgagggaactagttttgtcataatactacacccctctattgtttttaaataagaaaaaaaaaaaccccacgaaactttccatcaaagcaatggtccgtgttggcctgatgctttaagaagtttgaggaggtaggtatggaggcaccttaacaccagtttttgagcagaagttctagaagctgatttagaactacacagctatggatacacctgatgaaaaccgcaaaaggcgatgacaggcccagaaatatgaccagcaagcccgtgagcctttggggcatccgactgaatttgaaaataataccccattcagatgaacattaaaagccaatgtactggaattctctttgttctgcccgacatttgggggtgtccaaggacctgtgtttttaacaaagatgactttatgaccgttctaaggattgaacagattcctgcacagggtgccaggtttcaagttaggtcctcttagtataagctctctttttttctgaatgtaaacctatttgcattgtcatttctaataatccagtaggtttctggatattgtaaagatactgagtacagatataactgtgtaaatttcatagtgttttattttgaggtgagagttttgttatagtttataaaagatattttcctattcagacctcagggctattttgggacctacaaataaatgtgattcccagcagcttcaatttttgatattcaaaaagttaataatctttaagctaaatataatgtgatatgattcagaaaaaaatgtttttcccttttaacttctaacaaattatgtatctaatgtttaaaaaatatggaaaaaagggataatgtaaaaatgtgggagaattgtggctaaagaataaaaaatcacttgttaaaacgcattcttatggtacaaatgtgtgatatttaaataaacttaagtgtgtataaattagagaatgatacagtgaaatataccaggatttttcatgtcacttcttttcattgaaatagacgttcactttcttatcgtgacaaactttcaccttatttttcaaaggtaagatttaaaaattgtgagttccccacaaatagtttgtcacatgttcagatgatctcattacaatctgcctcttctcagaagaacccactggcaggtgggcatccttcagggatgttgccatgaatttatgtacatacataaaaacaagaatataattcagtttctatgtgttcttttacctaaatggtacactgtacaggttgtccattagtttcttttctttacttaaaatatgtccctagagagctttttaaagaatttaaatattttcttttgacagctaaaaaagtaatacacaaatatgagaaaaaatgtaaacattgtacaaagttctcagatgaaagtgactttaccttcccccaagacagtccctcagaccagctacttgtacatccttttagaaataccttttgaatgcgttcttccctccgtactgtgcaaacagaacccgatgggatatagagtctcattcactcactgtgttttgggaagggcatgttggtccctgctttgttctttttcattgctgtgtagtattcctcagcagaagtgcaccatggttcatttaaccattttctcatgggtgaacttttcaaatggtcccggtttttatgatttgctagtaatgaagatccttgtacctacccaattgtatacacaaatggatatcttttaagataggagtgcagaagtgagatctgccaggtttcaaagaatatgtgttttaattgctatagtcactgccatggtgcactttgcaaagctctgtggtgtgtgcaaccaccagcagggagcaagagaggccctttcccaatagttagaaaattgtatctcgttttaattttcatttcatttcattttcccagttgttgatgtggctgaacatcttttcacctgtttttcaacattttaatttcctatttttacacatttcttatttatagccatgtctcatttggtgtttttttttttttctttctaaggatgggggtggtgggtggaattttatttattttgttttttttttatttttgagacggagtctcactctgcctcccaggctggagtgcagtggcacgatcttggctcacttcaacctctgcctcctgggttcaagcgattctcctgcctcagcctcctgagtagctgggattacgggcactaatttttgtatttttagtagagacggggttttgtcatgttggccaggcttgtctcgaactgctgatctcaagtgatccgcccgcctcggcctcccaaagtgctgggattacaggcatgagccaccgtacctggcccctcatttggttattatttcactttttggtgtcatttttgctggaggttgatatgtatttgggatcatatttcattcatgtggtgtgcattttctcttgttttattaaggtattttctgtagtgtagaagatttaaattatgatttagtcaaatttgtctaacttttgtttgttttggtatttgcatcctgtgttttttttttttaagaaggcctttcctaccccaaacgaacaatctttttcttctatattttcttctaatgacctataggtactttgcttttttccttttagctgaaagacatgtacctgtatacacaactcgtttaggttatatttgatgggactgaaaacaaccagcccctatttatttgggaagctccatttcgaacgtaggaaatcggaagtctcaatcattaaataccataatctatgtgattattaaggaagagtctaagtagggaataaaattttacatatgaacctttgtcctagggcaagattgttattggagattatttgtgctcatttgtgaaagagccaataatgtgtgtgtgttgggtgaaacatgattgaataggaaggtcacacacaagggaggatccccataggaaatccaaagaactgggacgggaaaagggaaatggggttggggagggttgggagaaaggtgatcttgtctccttcatcttcctgactggagatactgggggaacggtgtactaagttctttcccgtggaagatgggagcatcttcccagggagctggcccagtccagctgcctcgcggctgtgtctgcccacgctgggctgaagtggtcaagaacgtccgctgaggattttacacatagccccttgtgatcctccttcaccaaggccctttacatggtctttgctcccagcaggtcatgcctgccattttccttgatgatgtccaggctggtttccatccagggacatgaaaggtggccccaaagcttccagtctgatgacaactttgatgtgcaaattgctcaggcagaaattgtcagcttgccagccaggggcttcccagtcctgaggggtcactgatccctcagcagtgtggcctgggcaggggtggggaaggggtgacagcccccgggcaggacggccaccaccgccatccccctcacatcacctgtacttccagccttatgctgcctaagccctttactgctttcccttaaaaagccaacagaaacctagcaaaaggttaataggttcttttggctaaaaataattaaaatacatcaatccaactcaaaagcaccttgatattccaaaagcagtattttaaaaaccaatcaagaaattggtcagctgcaaggaaaatacttcacctttttattagctcttatgtaagaaagaagccttattcatccctacagcctaggtgagaagctagactaggaggcccctctctaggccaagggagacaggagggttcaggtgcacggactgtgcggggaagccggtaccctgtactgaaaaagctgtggaatgtcctcactcccagtgcaagggggtacttggggaagccaccctccagcctgggctaaagatggccagtctgtgtcctgcaaaaagggcctgccttggtgtcagccctgggcaccccaatgccccttcaccccttgtcgggggccctgacctgcttataggccagggtgatcatttgaagggatgacaagtcctgcctcgccaagccccatctgaaagggcctcccaggtgcacatgagcgtctcctggcttgatttaagcccacaatgtctgttggagcatgagaggtggcaggtaggggtggttgagccaccgccacctgcgcttcctccccctgctttgcaggtgctgcccctgagtgtctcctctgcgtgctcagccccaggctgtgttcctctaactctacacgctggtcctcatcgtggactcagggccaggtggcccttgagacattgcggcaactctcatcttctcagtgatgaaccgcatttacctgcaccatggctctccatgggcggtccccggaccagtaacatcagcaccacctggaaaattgtcagaaatgcaggttctccagccccacctgtatgcctttcttcgagttgccttagccaattaccgcaaatgtggatagctggaaacaaatgtattctctcaaagctttggaggccagaagttcaaggtcacgcgatgttgtcagggctgcgcgccccatgaaggctctgcgggaattccctcgcacctcctccagcctgtggcggctgctggcgacgcttggtattccttggagagggcctccttgtggagagggtctccagtctctgtctctgtcatcacgaggccattgtctatgtgtgtgtgtccaaatgttcctcttcctataagaccacgagccattggctcatcgctaccctcatccagtgcaacctcatcctaacttgcttgtatggacagagaccctatttccaaataaggtcacattcacagggacatgggttagaacttgaacatattttgcaggggacacaaacccacaccactaccacagactattgaataaggatgttgagagcctgggagggccctcatcccaccaccccggccagctgcaaatctgatggtaacttctccatctgcgtgagggagagatttccaccctggggcatcgggttggctgcgcacccaacacctgacactggacacactgtcaacagtggtgtattcaccacatgcactcacagcccaggaggaggccactgcctgccacacagaccacagggggaacagtgtgaacaaccaggacctgggagaggcaggctccgtggtatcgagaagatggggtgcccccactccgtctccataggaagatacaatcggctcgttaggaacattgcaggggctggtgggccatggaagccgctctgcaggggtagcaggactgcgtctggtccagagacaggagggcaagttggttgggggccgtatccatggcagcagagcaggacagggctgcatctggtcctgcaacaggagggcaggttggctgggggccgtatccacggcagcagagcagggagcacagcgcatggttggaccactccattctctcctgggttcacccagagtcaggagcaaaaaatcttgaattttaatttcaggctttatattgtattatttgtaaaatagacctcaaatccttcacccattctctgctaccagcctagcctgagctaccatcacacctcccagacaacggcctcattccacgttcgttccccgcaaatccatccttcccttaatgggcagaaggatctgttgagagtatggatgagatcctgccactgtcctgctcaaaacctgccagcagtctttggttgcacctagaaaaaccacccagcccctgtcccatggcctggaggcccatggggtgtggccctatctgctgttcctcttcctgctttccctgctcagccttcagcccagtgtcattgctcaggtccttgccgggcccccagctaaatttagctccccttggggtgcgctgccccccgtcaccctcctctttcctttatggcattttctatactcttctgcttggtgtccattccccatgatgtgtccgtcccagcacctaaactgggcttggcccacaggagttgctccctggtattggtgagctgacagagaggagggctggggctactttttgacttgggccttgcgactgagtgggaccatgagcagagcacagctctccaccccagggcagcagcccggacctcggagtcacggcatggcctgtgggtcaaccctgcccgccttggctgtggggcatgggcatgttatttaatttcccatgcccagggtcctcatttgtaaagtggggattgtagggtttgcataacaatttaattaaatgacagaaattctactcagatctttaacaaggctgctgcagagttggaggccactaaaaggtagtttcctgcctttctctgtcctgcttcaaactaaataacagatggctacaaaatccaggaccacccagggtcatcttccagagggccagtcactgaggctgcaggtgagggagttttaaccctccccccagcccctgtctcccacacccactggctcactttccatcagctctaaaagtttcctgactatccaggggccacagctgcggttgcctgggcttttccattcctgagactaaaagaatgttcacagctggaacctgcaccaaacccacccagtgaccccagatgaaagccccctgtaccccatagagaggcaggagcagagagagggcctccagtcactccgtgctccagggtccagggtccagctggggtttccagctcccctgttggcacctgttcccctctgcgtctctggcaatgactcattcccagggacagagctgccttcctgggggatgagcaggagctgcaggaagccagaagcgaggctgggggcagtggtccacctcctcaccccttgtgcccagggttcagaaaagtgacctgccaccagcggccgcctattggcgtgtgggaggtggctgtcctcccaaatgctgcaggacattgctgattaggctgcttcgatgtgggcgttttttgactaggggcatattaaatggcaatggaaaccagcgaaatcagccctccgggagacagcaacgcggaaagtacctgctccattaggctcagcctggctcttctcccagaaaagcagactggatgaaggcactgggccagcttaatgaaacccagcagcagtccacgtattctttttttttttttcatttatttattttattaaaaagctaaaatatatatttaaaaataactttaaaactattgaaagcacctgtgcaaaggtgggggaaagtcaatttgagtaactaggaaagccacaaaaggacccactgccctgtgtatttttgtaatttttgctcctatctctgcaagtaataactcaaacattgcaatcacatgcaactaaggtaaaatgaggtaaactgctctgcagtgagttcttctactcagaaggcagtaggtgagcatgctggaagtcacatgatcaaggctgcatctcccatcatccctctgggcagtgatatgggatagtgggtctctttgaggacttccaagcctgagagggggatggacaacatatgattcattgctggcttgggtccatgtctgtggtcaacttcacataattggatgggaagagccccacttgtccattgacttctcctttccaccagtcggggtcctccttgttgaggatgttgatgatctggcccttgttgaaggccagctcatcatcattctgcgcggtgtagtcgtacatcccaatcacctggcacactgccgctaatgctgttgacttaggtggctctgttggagtgattttgctcgtcccagggcttagaagctttacataattagctgggaaccagcctatctggcgctttttcccacgtgcttgcagctctccttcccaccatccacctgggttcttttttcagatcaaaatcagctgaccaggggcgagagtgagctgctcggggcccgtggcggtgtatgaggaaataacctgggcaatttcaggtttttttcctaaactccctgatttccccagcagttccagagccctctgaatctttaagcctcacatagttagaagggaagactccggccttgtcgcccactgttcctgtccaccggtcaccatcttcttggtaaccaaaatcacatctccttgctgaaaggttaaatctccttgctcagaactctggtaagtgtacatggcaataaattcttctcccgaaacgactggcttagcagtccacgtattctaggctgtgtgagaagggggcttcaggggcagagacggggttccacccctggctacacagtttctccagccttggatgcatactctctgtgtgactctgacagtgtttgttacgtcctagagaagagcaaacttctgaattcgctgcacaccctgcctgggccagtcctggacagaacgatgctgggggccactctgagcacagactctgtgcccatcaccttgactgacagtcctcaggggttctccatctcttctctgcctcctacccccccaccgatcaggaacagttccccaacctcccccaccccccagcaattcttgatggaaggtagatcagcataatacagcctgcagtggggtgtgttttaaagcaggggccccaacccccgggctaaggcctggtgctggccaaggccacacagcaggaggtgagtggtgggtgggcgagcgttaccgcctgggctctgcctcctgtcagatcagcagtggcattagactctcatggcagcttgaaccctattgtgaactgcgcatgcgagggatctaggtctcgcactccttatgagaatctagtacctgcctgatgatctgagggggaacagtttcattctgaaaccatctgctgccccctctccggccacccatccgaccccagtcattggaaaaattgtctttcacaaaaccagttcctggtgctgaaaaggttggggactgctgtttaaaatccttctgaattctcacaccttccattataggtcttcctccaggagaatcagaccacagctctttgccccaggccctgtgtgagccccggctctggtgcgtggccttctagcaggtgaagagatgcactcgctccttgtccctagggccatgctgtcatcatggtctggaagaccccgtggtgtcctcagtaccagcaacagcgtcccagaccatctgggcccaaatctttccaatcctggtaagaatagtcggggacccccaggagaagccccccgcttctctcagagcctagagtgaggtgtggcgaagaggcctggtctggggccctctgagaggaggggacccctctggggtggatggtgtcccaaatctgctctcccaccatccagccacttggaactaggagaaaagctagggcgacaggaaacgtgggccttctgtgaaacaatggagcctctcctctcggccccttcaccctgcaggtggcacccaactgcagcccgtgctggcatcctcagggctagagctccagcaagcatggcctgctgctgcctctacagactgcagaacacagccaatagatgatttcattatgtccaggttcttttctcatctccaagcgaggaaaaatcatgccgcttttgtaaagaaattatggacacatgggaagcttcagaaaatcagggctgagaaaggcatgtgacaacatgctcagacacggcccactgcccctgtatttctgaccaatgaaacagtatgcaagggggtcttatttgagactccctgcccagaccgagcacagagagtggcatgctcctgaccctcgggcagcaactgctcccccaagagaagggccttggccagaggcagctgcataaagaaatggggctgaggtggctatggagccattcgatgcctgtgtctacatctgtttcccaaaaaggttatgggtgcactaggcacccagactgtgaggtttcaggaaatagtttccaagtctgccctcacttctgacagcagctgcaagcttggagggttccccaagctacctcccgcattaagagtttgctaacaggattcacagaactcagtgaaagctattatactcattgaatacagggcaagggcactgacagaaatgagccaaaggcagagaagcatggggcgtcagggagggtctgaaatgtgaaacttcccactgtcctaaggatgtgtcaccctcctgagattgatgtgtgacaaatgcatggagaattgtcaaccaaggaagcttgccagagcttcagtgtgcagaatttgtattggggcctcactatataagcatgaaagaatgattgattgatcacatgtgtaattgaaatcaggcaccaaggccactgatattgtgtaactcaaagccaccattgttggtctttcctgcatggccagttcttatcctgagactgtcagatgtggctggctctatgctaaggttccatgtggccagcctttgccaccaacaaagacactcctatcaggtatgccatcagtcacctcctagagctgagggaaatggccagaacccctctgtgggcaaggccacattttttcctatgtacctggctctgggctgcactggtaacaagtcccatgaggcccactgacatccatgcagacatacttgatactgggtctgattgtatcccagggtcatgccgtgagaacagacacagagaaaatggcagaacccggcttccacagccagtgatgcagagcttaccaaacgaaggttaaagaggaggtgaaggatgagtcagttacaacaggccccacccaaggggacaactccaccaacccccctgctgggcacccatgctccctctggggcctcagccttgacttttagtctctgtatgttttcttccctcctttgccccacacatccttggagatcctttctattgtccacaacttgaacgctgacttagcacaattgaaccagtagttggctaggcgggttatattctgttgccccagtgtgctctgtcttgaaagtgggttctactctatttttttggagacagagtctggctctgttgctcaggctggagtgcagtggtggggttcttggctcactgcagcctcaacctcccaggctcaagcgatcctcccatctcagccacccaagtagctgggactacaggtgtgtgctaccatgcctggttagtttttgcattttttgtagagatggggtttcatcatgtttcccaggctgctcttgaatgtctgggcttggccgatcctcccaccttggcctcccaaagtgctaggattacaggtgtgagccacacgtctggtcggcctctgctgttctgagctcatggtttcacaggggagctactgaaaggtattgaagagtaatgtctcttcctttgttcaaggttctggaaaacccattctggcttggccattgtgagcatatgtaccaggttaggtttacctgcacataacagaaaacccagtaaccatcattgtcactgtcattgtcatcatgatcatgatcatgatcatggcctatacttataaaagtgcctaccatagtaggaccccaagagttagaggaatagttaggtcctctaattgcaagtcacgtaaacatgacataacatagagaccatttcatgctcgttttacagatggggaaatagatacagagaggtcaagtaacctatccaaggtcttgatgctagtgagtgaaggtgctgagatataatccggggtgttcagcctcaaaatctctactccaaacttttctgttacaaccaagaaaatagtggcttaaatacttaagggtttgtgtctccataaacaaagtccagagaggcaggctggggcgatcatggtggggccactgtcaccagggacccaggctccttctgttcagtcatccttggaaggggctggtattccctcattgcctcatgatctgaagtagctgctggaggacaagccatcacacctgttttccaggcaggaggaagaagtgagggggaaaaacaggcaaatcttctggatgagtcagctccctttaagataccatccttttatatagcctattaaccagaactcagtcatgagtcacacttactgctaggttggaaaatggagcagtagaactgggccaattgctggcgtggatataacgcggctccagtccaaagacagaggggagaatggacactgggaagcaacttggcagcaaagccaagaaaatcagtttctttattgtgttttctttcctgaaacgtctcctggggggcaagagggaagaggccccatccttttctctgtctgatttttggagctcttcatcattctagacctgcttgccccataggactttctcttacagttccctgttccagggaccctgaagaccagccctgcaatgtgtgcatagggggtcctatttggtgctgagagagacagggtctagagcatagagttggatttctgcacagtgaaagcaggactgaagtctggtctttaaagatttcctccttttcatgatatggcccactgtcattgtcattgttatcactgacaatgatgacatctcttcaagattaataggtttcagacttatagtgttaccatcctgggaacaggacctagacacctgtgaggttccaattattgacctaaacggttgacaattggaggacctagctgttcctctaactcttggggtcctactttcacctgaatgatggattgatttgttccatcaatcaaatgtgtgaaaatgacagtggagcttcctgctctttaaaagttggtggtagaaatcatagctgtcatattgatcttagctttgccacctactagctatatgatttaagtatgttattttaccacactaagcctcagtttccttacctgtaaaacagcaatgacgaaaatgtctaccagtaggatatgtgagcatctagcacatagtaagtgtccaataaatgtgaggaggaggatgataatgatgatcatgatggtggtgatagtggtggtggtggtgatggttatgatcatggtggtggtggtgatagtgatgacaaatgatggtggtggtaatgatggtgataatagcaatgatggtaatgatggtggtaatgatggtgataatgatgatgaaggtggtgatggtgagagtgatgataatggtaatgatgatggtgatggtaattatggtgatggtgatgatggtaatgatgatggtgatgatggcaatgatgatgagggtgatgatggtgatggtagttacggtgatggtggtgatggtgatgatggtggtgatggtgatgatggtggtgatggtggtgatggtggtgatgatggtgatgatggtgatgatggtgatgagggtgatgataatggtaattatggtaatggtaatgcaatgatggcaatgatggtgatgatggtgctggtgatgatggtggtgatgatggtgatggggatcacgacggtggtgatttaggaccagaatctccttcagtgggaaatctgtctacttcaagacttttgtgattaatgaaagaaaaagtataactctggctaaatttatatgggttaaacaaagcattaattaattaataaatgcccatttgtcattgtcttatgttcaggttagttaattgtccttgaagaaaatgctggtttagtgatctaatgctctttcttagacactgcaatagtgttgcccctgaaaagtaataatcttttggttttgttattgtttcctaggataactttctttgggatccttttgatatactaagagcatctgtgaggatagccgaataactattaggctgaaaaaaaatagtattaaggcagcgaaaatactttagctgtgaaactaaacaatacatatatgaagtccttagcatcatttagggctgttaaatatatgtgatgtgacattacaaagcaatttgagatgatttccttagtatgcatgatggaaatgattcataattaccccaaataccatttcttaggtattgtttttatgcatgtattaattatggctgtggttgtttttgtttagagatgctttgtactccagtttgtcttcttaggcacagccttgcctgtgatggggcaagtctcaggatgtgggtttcttgcattggccactggtcccactgggtgaggatggaggtgtcattggtatagaaggtagggaatttgtgatgaaacttgcatcttttgaaaagttttgttttgtacagtgctctgaaatttgtcttttatatatgcgtgacgcaatctagttgcacatgttgcagctaaaagcggaaccaactaattgaacattttcagagtctgacggaaatggtgggtgccagcattcctagtctatcatccagttagtttggaggcttgggtaagtgccaggtacggtaagaaatgaccactttctcccagaactcacatctagccttcactcctgtaatagaaacagggatttgttgagcggctgcgataggtaggaattctgctagcagacagggacacaggacaagggcaaagtccctgccctgaaggagatctttacctacatgagtttcttttcatgctgcttttctgcagacacacacattttcctctcagctatttatccctttgccatgcacactgatatctgggaggttaatcaacttgagggacacatggttcattttggaaagcagctgcaattctttgcaaagaggtttctagacctgtttttgagaatatttaaatcgctgagccaaaagccagtgtgactgtccttcctgccctaggtgagtgtgctgggaagccaccgaggacattgatcttggctcttctttgtatcagtgattgagaaaacaaacactatgctggagagccactgaacgctctccctgaaggcaaagatttgctttatctaaaattttccattgcgtccaggagcaaatctgcatcacagcaatttactattttctgctccaggaactggaaaacacaagcttgagctacgttagctgcttccacgaaacgtgctgtcatcactgaaacacatgtattttttttttttcaggattccaggttgagggaaatttgcttttgattgtttaattgcattattatagatttttagtggcatctctggcctccatctactagcaacctccagacagtgtcaaatgttccctgggggggcaacatcacccccaggtgaaaatcattgccctagaaataatgaagatcattattagtcctctaagcacattccatgttctcagtacatccctatttaaagactaacacaagtgggtttctggtgacttgcacaggaaactgagtccttatgctgcaaaatgttggagtctttcttttaagtgacccttggcagtgcagaatgctgatgtcaaaatataatcaaaagctcattccgggcttctgggtagagttccaaatcctccagattatattagttcattatagcagaccatgctggggcttttccagttgacaaattagatttttttgaaagcatggcagttggatttatgaaaatatttaggattaaaggggaggatgagggaaactaattttctcttgtcatgaatgcccttaattgaattttagaaactgtttgaaagagcaaggtgaatgctagacagaaggttgtaaagatgtgcagataggtcgaagtaaaaacacatccgagatgctttaaggacccagagaaaaatcagccgcaatgaacacttactttagctaattttatgtgtcaactcggctgggtcatgatgcccagatatgtggttaaacattatcctacatgtttctataaggatgttttgggatgagattaacatttaaatcagtagactttctgagtcaagcggactgtcctccattatgtgggtgggccacatccaatcagttgaaggcttgaatagaacagaagattgaccttccctgagcaagagggattctgccagcagacagctttcggacttgaacagcagcaccagctcttcctgggcctccagcttcctgccatccctgcagatatgggatttgctaggctccatactctcatgagccaattccttaaaataagtctcttcctatatgtgtagcatgtgtgtgtacacacggataaacatgtacacacacacacacacacacaccctactggttctggaggacctggcgaatacaactgtgatgaggatgtctcaagttcgcaaagcctcatgattcgccaccaccaccaactccctccctccctccccattcttcaggcgcatatggctgccggcgcctcctgggagggttacaaaatgcctatttttttgttttgttttgttttgtttttgtttttatactgcagaggtcagcaggatgccaagtcttagggaaaaagtttactttcgaatttgtaaaaagcagcatttaaccagcacagcagctgtgaagacaagaaaagctgcagaacagcagaatagcatgggctgccgaggcagaggcagatgctttaacaataaccaatgaatgacaaacccactgggtctggccctatctccccatggctctgctctctcgcccccaatccctgccctttctcaggctgcctgcgtggcgctcatccaggcctgggtgtgccctctgcttggctggtggtcattccacggtctccttgaccaggttcctgtccaagccatgggcacatcacaccctgtagcttcacttcctgatacacacacgggggttcacctggtgcccaaacctagtaagtggcaggaggcaactgaacctgagccctgcctgagcttccgggttctgcggtccaggcactggctccatcaggggccggttttagtttgaagaactggagctaaggaggttctttgaaatggtgtcgaggtggcagaactccaggacacatttgaatagggtccctgttctccttcctccctggacccagaaaggaaatgtcccagggattctctccctccaggaggggtctgcggagagagggggtggccccagggacctagcctctgggtcagggtggagcaacagggatgtcccaggggcacattgcaggcacagggaggggctgcttgcttctcgggtggtcgcaggggagagctcagggcttgtggtccatggggcagcagatgaatgagtcaggggcactggaaaacgatgtgctcctcttggtaacccctccagtcttggatcattccagtaacacttgtaaacgttatgaagaaatttatcagcgaaaacattcaaggcgctgtgctttgtgctggggccacctgagtccagagactgcggtggatggcatgcgggaaccagaggcacgcacgcgccgctgacctctgggtgacaggtagcccctggagggtccttagggcccagcaccctcctgcccatccctgctccgccaacactcacctgggcccctggcctcctctccatctcctcattgtttctgaacacagtcttgattggcattgatccaaccatccctttctggaatcttcttgccaactgcaaatctctgtacccctctagcaccctttgtccatactgggacccctgtcctcatgatcccagtcacgcctctcatttactgagcatctgtattaaccatgaggttagcgtgtatgacttcttttcatgctcacaaaactgagaatgcagaggtgcaattgggtaggtggagactggggtccagagacgctgatggaggagcctcttgctccagcagggctgaagtttgagcctgggcaggggtgactctagagcctgtgcttgccccggtgcagtgccatcccccctctcccttcctcaagcctgccattcaccatctggcctttaccacacataggtgctcacgaccctgtcttccccggctctgcacagcagaggacagcttgtcccccacactgtgtccctaatccaggggcagcagctaagcagagcttcttgctccctgtgggggtttttaggtcaccatttgtcctccttacaggtctcctttctccgtgttttatgccttctgtttaagctcagcctttcccggtccttactgctgtcatctaatcacccctgggatgtgctgcttccctgaggatttcagtatcagtttcatagtctctggggtctcagcatccacactgacccttccaggttttctcttttcctcgactttcctcaaatggctccttgccatcctgctgactagctcccctgagtttctctgactgccagtctctcttgcctccttcagacccccgagctgccctttccatgatatctgtcccttctgggctagcaggtgataacgtttgtttggtaattgaacataagcctttacggtgacactgcctgcgtgcaagtcccaagtcttccaagcctcagtttcctcatcttgtaaatgggtatgacaacatggggatccatctcctggagcagatggtgcgcgtctatggctcagacagtaacgcacgcctgcacagaaggagcacctggtgtgagtcagccatccctgtcccctgggctgggtcccgggctcagtgattgtgggcactgtgggaagcgctcttgatccttcggcccatggccatgctctggccccatgttaatccccacgcttcactgcaggcagcctctacctcttccaaactcccccggtcatggctagagaaagtcctaagactggatgcatcacttccactacagatccactctcctgtctcagctccgtctttccaggctcagtaatctttcgaatcatccgttagtggccttgcatctcaaacaacctgatcttctcagcgccctattctgcagaagctttctcataggtttgttgagaaggctggctgtacatctgcggtgggtgctctctgctgtcctcttcccaacctcagtgtgactttcctgcgtccacattgacttctgtccctctcgcctcccctcaagggtgaccttcctgctctggctcatgaactcaccctctgtggggccccgggacctctgctgtcaatgaacatcatgcagttgttctctttcttatgccttaaatcactctggggcctttccccacaaccatgtccaagtctccctgtagctcaggctaaaaacaacttttcttcttcaaacctaccctcccctccagtgaaggtcttacctatagcttcccattataggcaaacttttccattcctaattttgcgaaatctggcttccatctctccacttaccagaagcccctgctctagggtcacagggtgatggaatgcagtcacctgtctgcagctccctgtgtcccatctgccagaccccctggcactcatgaccttgtgtgtgctggtgtgcctctccaaccttccctcacctggcacctctgcactcatgccttcagtgtgtctccatggcctctccgtcactgagtccctgcctttatcagcatctccaagcagatggatcccagatgtctctccagccctggcatccctccaagcagtggtctcaccttgtcaaagccctgcacagtagctctgcttggaggccacgtgggcacactggagtctgcccagaatggtctcttgcttcccatgttaattcctcctccattcacgctggcttttcttaacaccttcgccaacatcctggccatccagtcttgaaaccgcagcatgctcttgacccccttgcccttcgcatcaaaccacattctgtgttttctgttatttagtccctagaccatggcagggtgaggtgtgatgggttgtgggatcagaatgatctggattcaagcctcagctctgccatttgctaacagtgacttttaaaataaacatctttattgagatgtatttcccataccacacaattcgcctaaaagtgtataattcaatggcttttaaaaagcatattcaaggttatgtgcaagtattaacatggttgattttagaatattttcatcacctcaagaagagactctgtaccctttggccatcacttccctactctccctgccccccaccagccctaagcaagcactgtctctacagatttctctgttgtggacatttcatatgaatggcatcacacaagtaatctttggtgactggcttctttcacttagcatgatgttttcaaagttcatccatgttgtagtgtgtatcagtccttcattccttttcatggctgagtagtactccactatgtggctatacattttgtttattcattcttcagtggatggacatttgtgttgtttcttccttttagctattatgaataatgctgctataatcgtttacaaatttttgcatggacatgtttcatttttattgggtgtatatacctaggagtggattgctgggtcatataactctatgtttaattgtttgaggaactgttttctcacttgagaaactgtttttctgttttttcacttgggactgttttcccaagtggctgcaccattttgcactcccaacagcattgtacgagttccaatttctctgcattcctgtcagtacccttgtgccatagactttttggttctagccatcttggtgaagtggtatttcattgtggctttgatctgcatctccctggtgacgaaagacgttgagcatcttttgatgtgcttattggccaactgctaacagtggctttgacactggatgctgaacttcagtctttcctcctgtaaaatggtacaaccaccatccatggagcacagtggcaacaccgcgactctctgggctgaggacacatgcgacagcaagtaatcccacagccactggacccagggacaggcagcctctgcagccaagggtcctgtcccttcatgtctctgcttccagtcttttctctgtacgtcctgcagccaggcttgggctgctgcacggctagagatgctttatcatgaaacctgcagcaggtgaaggttctcccagcaaagtttttgcagaaaagtgatgcactaagtgaactgttcttcaaatggtgtgagctgggagtgaggtttctggcttttcagcacatgggtgatgttcttgggtgaacgatgtttccccaaaagatatgtggaagtcctaaatctcagtgcctctgaatgtaaccttaattggaaacagagtctctgcaggtgtaattagtgaaggcgaggtcatagtggcatagggtgggcattcatctaatgactggtatcctcagaaaacaagaaagatttggagacagacacatagacaggggatggccatatgacagcggagtcagagaccagagtgatgctgcccacaagccaaggaatgccaaggatggccacagccgccaggagctgggtgaggccaggaactcccactgagtctgtggagggcgtgtggcctggccaacacactgatttcaaacctctccagaactgtgagagaatacattcctgttgttttaagccacccagtttgtggcttaatttgtgactttgttaaggcagcaatagaaaactgacacaggataatgatgttcaggaatgatgtggagagccctgggggtggttctgttccatgcttgttggatgcttggcatttctggccaccacaatgtatttactgagaatggactctctgcccagtgacagaaaatgagtatggccctggttcctgtcctcagcttagcatgggagacaggaggcaggaatacaagcagcagcttcagaggcaacaccaggcaaggccagggttgttggaggcgtgggctccagccactcccaagccggggctctgaatgtggcccctggtgctctctctggtgctccctgacaaatatggccctgggtgagaaaacctcaggcccctcccactcaaattctgatttgattctggattgccagtgtaatagttgtgattattttctcacaagggttacaggagaccttctgattaaggcaaacatcttgtacatcaaaagctgctcactgtcacccctgggcttactattcatcattctctcttaaatctgttcccaaagggcctacctggcacaggccagctgctgggcccaagtaatatgttttaatcaatggtattaagctttttccatgttctgacattttaagtagataattagactccagtcaccaggtgtccaacagttctacttttctatctggaaaataagttttgaaaatacctatcatgtacacgtttgtatttctactgaaaccacctggcaaccctggtaaaatgtaaaagggaatctctgatctataagaaaaaacaaagctggagagaaatgcaggagctttattataaatcatttaatattcttgaagttaacaactgataaactcatttaggcaaacattttggatttaatgatctaaagctcacagatgcatgccacatctagctaaaagtacataaaaagcgcacctctggaaataacagccctccctctggctgaagactgagaagcattaaggatgcttctggatttctgcagcggcagggcaggggtctgcacaggcctgacctggtgttgctggagcgcggcatcccctcctgggtgctgctccgaaaggcaggctgggaggtgcttgctggggtgttccatggcagcgctgccaaccaagtctgggtctctaaaagccaccctcagtttataccaactgatcaggaaataggtggtgacagggccttgaagggtacatgccggcttcccttaagttgattagatgggaaaccaaacaccgtctttcaagtgtgaggctgtgccatgctccctcagggaggaggggcgctgggtctgaccaggtctgcctctgccctcaccagctggcagacgtgaactggagaacagcaccagaaaggctggtggttggcagctgctcacgacacagttgctgacctgcagcagatcggctgtgggtgagcaggacagtcaggccctccacaagcactgttctggagtttcgtctgactaggtgaaccctctggcttttcgaggacgcagggtaccctactgccaccagccagtgagcagactaggacatctctagacaggaaactcatctaaaaatcggaggacaacctgatgcacccaagtgacaatggacccaggcagctgtgcacaccaggtgggaggcgtttggaacagttagactcatcagtggataggtttttctagcacaaatggaatgtggtgtctcatgtccctagggagacaaagggcaggtttcttatctggtctttccaagctttcaactctctggctcaagtgtcccagaatgaactagaagtctattcctccaccctggtccgtggtcacttccagaactctgaagtggctcaggaggtgactcctgaaaggcagcccttgcttgatctcctggtggagcctgtctgggctgaggcgatgctgggcttgccgtgccgagatctcatgccagaagtcctccctcggagctacctgtctccagcctcattctttggcatgttgactcctggaattgaggggctatttctaagatgcatgctttttcggcttttctcatgggtgcctcatcagcctgcacaggatcccccatctcacgagagagggaaatttggcattgctgttccctgcctctaaggtcctttatgaggggccgcccaaactcattcccttagttcttactctcccacaggtgttgagattttattggcccatactaaaaagcatgcaatgactgaggttttctcctaaccttaatctcatcttctcaaatgtgtgccttcttgtttttaagaccatagacaaggacgtcaggtgactgctgaaatagaactaaagctaaaatttttctcggatcttggcaaattctgctaatggcacctctaggggcacaatgatcctcaaatgacatccaaccagactccccataaacaaggtttgggctggagctgtttctagttttaaatatggaaatgtaaggcaaaggacagagcacttggttttgccttagatttcccagcagagtaggatttgggcgaaactgctggttctctctgtcagggaaataccaagtgcagcagagccggggccatggggcaggctggtggactccaggctcacttgcgtggctgctggatgtgctgggttcttggggaaggatgcttgtccatggaggcatgcggcttctggtgagccacctgcgcagccgccggggggaaatctttgtcaccctgtcaggaaacacggaaagctcaggttaatcaataggaagcatggggtttgtgggtgaggaagccccaggccagtgcccaccagcgtccctgcggaaggatagcaattgtgtgtgaggaagcctcaggccagcatccaccagcgtccctgtaggaagcatggggtttgtatgtgaggaagccccaggccagggcccaccagcgcccctgcaggaagcatggggtttgtatgtgaggaagccccaggccagcgcccaccagcgtccctgcaggaagcatggcggttgtatgtgaggaacgtccaggccagcgcccatcaacgtccctgcaggaagcatggtgtttgtgggtgaggaacccccaggccagcacccaccagtgtccctgcaggaagcatggtgtttgtgggtgaggaacccccaggccagcacccaccagtgtccctgcaggaagcatggtgtttgtgggtgaggaagccccaggccagcgcccaccagcgtccctgcaggaagcatggggtatgtatgtgaggaagctccaggccagagcccaccagcgtccctacaggaagcatggcagttgtatgtgaggaagccccaggacagcgcccaacagagtccctgcaggaaggatggcggttgtataagaggaagctccaggccagcacccaccagcgttcctacaggaagcatggtgtttgtgggtgaggaagccccagaccagcgcccaccagcatccctgcaggaagcatggcggttgtatatgaggaagctccaggccagagcccaccagcgtcgctgtaggaagcatggggtttgtatgtgtggaaactacaggccagcagccaccagcatccctgtaggaagcatggtgtttgtgggtgaggaagccccaggccaacgcccaccagcgtccctgcaagaagcgtggggtttgtatgtgaggaagtcccaggccagcacccatcagcgtccctgcaggaagcatggtgtttgtgggtgaggaagccccagaccagtgcccaccagcgtccctgcaggaagcatggggtttgtatgtgagtaagccgaaggccagcagcaaccagcctccctgcaggaagcatggggtttgtatgtgaggaagccccaggccagcgtccaccagggtccctgtaggaagcatggcggttgtatatgaggaagctccaggccagcgcccaccagtgtcgctggaggaagcatggggtttgtgggtgaggaagccccataccagcgtccctgcaggaagcatggcagttgtatgtgaggaagccccaggccagcacccaccagcttccctgcaggaagcatggggtttgtgggtgaggaagctccaggccagcgcccaccagcgtccctgcaggaagcatggcagttgtatgtgaggaagcccaggccagcacccaccagcgtccctgcagggcaggcgtggactgtgaatggataaaggaaggtggaagtctgtcccttgtgggtgttagggggcctgggcaatcaaaaccagggaatggcaggtggcactgaggcccacacactggcaggacagcaagaatgctcactggctctgccccatgccgtgagacacaggaacatgcgactcccacagaactgacttggatgctgcggggtttcttctgctacatctgtatttgtgactatttaaattgggggcaggacagaaccaaatccaggatcttaagttcagatgtgccaccacagctgtgagccaggcctgggacgctggctgggaaggaaatgcacagggcgcctacgagacagagccaggttcggcctgtccagtctcaggagggactccctattttccagagggatcaatgggcttctgtgccaactgtgggtgtggccagggtggggtccacatgggcaggctggagccacacttctctggctggcaggttggctggctgcggtcacagctccaccaacagtgggctgtccccaacactggcactttcttcaggcatcctctgataagaaagtgaatgttctgagaacagcagccctatggacggcaatactgtggggttcactgcgggggtttgctgatgggagttcactggtgggaggtctgcgcttaagtcacaatgttgggtctcaccagacggcggctctggaaaggtaaaggatgcgagtctggcctgcggtctgcagaagcagcctctggggaaacgcggcaatgaagagagccatggccacagaggagatgagcagtggtgctgggttattccaggtagagtttaacaaaaccagaagcaaccaggagactccatgctgccatgcaaaagcctcaaacccaccgcagacactcccagacttacccgggcgatgaccccagagatgaacacagtgggtttaggtggactggaaaaaaagaagggaaaaggcagatttaacaaaacagtccacaacagggaacacggtggcagacgatgtgtatgtggatgagccaggctggagggcgtggaggcagaatgggaagcaaacctctcctctgcgttatttgttgtaatgatcacactacggggctcgggagcctccttctcctgaggctagttcagccccaagtacgagagagaaacagactgcagccaactgcgagtgaattgccttcaaccactttctatttgtgttttttttagggacagggtctctgtcacccaggctggaatgcagaggcacgatcatagctcacagcagcctccacctcctagactcaagtgatcctgcttcagtctcccgagtagctgggacaacaggtgtgcagcatcatacctggctattttcttttatttttgtagagacagggtcttgctatgttgcccaggctagtctcaaactcctggcctcaagccatccttccaccttggcctcccaaagtgctgggattacagggatgagccactgtgcccagcctatttttgttttttggttaaatcaacacattttaactatgggcaagcccatttatttggatttaatgagatcgtgaaacaggcgcttccctaaagcaggggagaagtagctttacatggtgtggacttggagactttctcactgcctcctcaaccctaggcttccccttccagcgtcctcacaggggagattctagagccaacacaaacctcccgtccccatcaatccctgagcattacaaatataaggtccttgggaaacatgtcacctcttgacatgttaactcacactgagctcacctaaactgccgagtattgagggaatggatgcagtaccaaagcagtacagctcagtgtgaaaaaacagacaagcccaaacaggctcaaatcgccagcaggtctaccacctggaaacacacactgttaacgtggggctatcctcccaggctttccttctatggacagatgtacgtgcttgtcttcttattaacttttttcttacaaaaatagttatactgttttgtaatctgccttctgaactaaggctatggcaagcatctctccatgtaattatatactcttctgtacacttattttttatggctacgtgtgccataatttaaaaacatcaggacacagtttgaggtagtggacaaggtgtgtgcacttccaaatgcctccaccaagaggtacagacacccaagacctggaggtgaatacaaggtcagcccagctgggacagcgcgatcgatcggggacactcacggaggtgggtggaggggaagcatctccctcttagttcagttttgcttaaggccagtcctgctgggtagagggggtagaatttatcccctgagctcaccagcctgtctcttcccagctctgcttctcctctgctgccagtggtcttttttaaggaatccacttgtcttagctttgttttgctgcagtcaaaagtcccagcattccgaaagttcactgactgtttacttccccaaagagtttaccaaaaacacctgaaattcccccaagtaatttctgttacttcgcgacattaagaaacttcaagttttactaagcagcacagagatgccccatacattaccttggttttatttagtgtttgttgtgtggttacccaggttggatttttttccccttcctttacgtacatgatttagctataggattaatagtcggccagaaatgagtaagctcagctcaagtttaaaagtcccgccacgtggtataactgaattcatttggattcttaaagcacatcctgctgtgatggctgataccatccacaggggagggcttccagggattcagggccaaggagtttgcatccaaagctcaggaactgtggtctgaattctaacattttagaaaagatttggaaaggaatacacaaatggcagcacaaagtttcttaacgtcgtttggaatgttcttttaaacatctaggaacagcctgaagcagggatggccccactctggtagcgaatcatatagtatcatcttcaacaaggcacagccgtctttccgtagcaggagtgcacagtggcttccactgtctccatgtcctatttgttttttaacctgctgaggctctgaaaggcggaaatgcaggacatcaccccactccagaaacttgatataaaatgtcatccatagagagtcaatctagtaagaatacatgcataataaagggaattagcttcctcaccaaactgagccctaaaaggtggctgaggaagcttgagtaattatatacatatataaacaccctcccctctacagacacacacacacacaaacaaacaccttgttttatggcatctgcttatcgcacttcacaggtaatgtgtttctttaggaattgaaggtttgtggcaactctgcataagcaagtctatgggtgtccatcttcattattattatgtctgttacagtgatctgtggtcattgatctttgatgttactactgtaattgttttggggcaccacgaaccgtgcccatataagatggtaaacttaatcaatacttgtcatatgtgttctgacagttctactgaccagccattccctgtctctctccttctcttcaggcctccctattccctgagacatagcaatattgaaattagggcaattaacaactctacaatggtctataatggcctggaagtattcaagtgaaaggaagagttgcatgtctctcactttcaatcaaaagctagaaatgacccagcttagcgaggaagacatgtcggaagctcagacaggctggtctcttgcaccaaatagccaagttgtgaatgcaaaggaagagttatgggagaaaattaaaaatgctactccagtgagcactggagtgagtgacaaggaagtaaaagagcattattgttgatatggagaaagttcgagtggtctggataaaagacaagccacaacattcccttaagccaaagtctaatctagagaaaggccctaactcccttcagttctatgaaggctaagagaggtgaggaagctgcagaagaaaagatggaaactagcagaggttggttcatgaggtttaaggaaagaagccatctccagaagataaaagtgcaaggtgaagcagcaactgctgaggaagaagctgcagcaagttctccagaagatctagctaagatcattgatgaaagtggccacactaaacaacagattttcaatgttgacaaaacagccttttattggaaaaagatgtcatctaggacttacacagctagagagggaagtcaatgactggtttcaaagcttccaagggcaggctgactcttagtagggactaatgcagctgatgactttaatttgaagccaatgctcatttaccattccaaacatcctagggcccttacgaattacataaaatctactctgtctgtgctctatacatgggatgacagagcctggatgacggcacattggtttacatcaaggtttactgcttattttaagcccactgttgagacctactgctcagaaaaaaagattcctttcaaagtattactgctgatttataatgctcctggccacccaagaccaagtatacaaggagattaatgttgttttcatgtctgctaaaacaacattcattctgcaacccatggatcaagaagtaattttgactttcaagtcttattatttaagaaataagtaattccactggtagatttgggcaaagtaaattgaaaaccttctggaaagaatttactactatagatgccactaagaatactcatgattcatgggaggaggtcaaaatatcaatattaacaggagtttggaagaagctgattccaaccctcatgggtaactttgagggggttcaagacttcactggaggaactaactgcagatgtggtgaaaacagcaagagaactaggattagaagtggagcctgaagatggaactgaatggctgcaatcttgtgattaaaatcctcagggatgaggagttgcttctcatggatgagcaaagaaagtgatttcttgagctggaatctacacctggtgaagatgctgtaaacactgaaaataacaacaaaggatatagaatattatataaacttaattgataaagcagtggcagggtttgagatgactgactccatttttgaaagaagttctaccatgggtaaaatgctatcaaacaacattgtatgctgcagagaaatctttctttcctgaaaggaagagttgatctatgttctatgtcacaaacttcattgttgtctttttttttttttttttttttttacagagggagagggtctcactctgttgcccaggctggagtacagtggtgtgatctctgctcactgcaacctctacctcccaggttcaagtgattctcatgcctcagcctccagagtagctgggattacaggcacacaccaccatgcctggctaatttttgtatttttagtagagacagggttttgtcacgtttgccaggctggtctcgaactcctggcctcaagtgatctacccaccttgacctccgaaagtgctaggattgcaggcatgagccatcacacctggcctgttgtcttattttaagaaactgccacagccactccaaccttcagcaaccaccaccccaatcagtcagcagccatcaacactgaggcaagaccctctaccaacaaaaagactgagcctcactgaaggctcagatgatcattagcatacagaatttttaaatttttaaaattttaaattaagttatgcattgttttttagacgtaatgctactgtacacttaataggctacagtggagggtaaacataacttttatatgcactgtgaaaccaaaaagttgtgggactcactttatcacaatatttgctttattatggtggcctggagcagaccctgcaatatctctgaggtctgcctgtacatattcattattgaaacgcagacaagcaaaacaagttaaaatcacttgtacttctgtattactgtacgtgtgtatttataaagattgacacacacacacaactactgtcccatcacaactgctgaatggccatggagactctggaggctaaaggagatccccagcaatgagggtggtctaccctgtgagtacgccaccctttgcagaggtggagtggaactccaggacgcagaggcgccatccagcagtagggcgccagcctggagaggcctccatgttgggtgttcctgacaggctccttggttgagcccagccccactgtgtagtagctgccacgtgaggctctcgggggacctggctatcaggaatctgtctccagcactggtcccctgtgtgcactgaggacgggagtctggagcccaggggcctgccacagtcccgcccttcctccctgccctcggtgctcctcagaggtgctgtcctctgggcgtctcctgcattgatcacgacaagggtggggttctatgcctcgagtatgtacccggagaaatgtgtgtgaacagtgatgatatgagatcatgacagctctgctctagcctgagtgctggaaaacacacacggaagctgaggcctagaaaccagcctctgactcccagggcacgctctttcctttcctaaacccacatttagcacctcactcccatgtgagctgctcaagacactgtcccatcgcaactgctgaatggccatggagaccctgggggctaaaggagacccccagcagtaagaatgaccctccccccacaggcccagctcattccaggagtgtccagggccatggttgcaggttgcagcgtctaagagtccacaggagtcattcacagatggcgctgtccttgtgaaaccccaaattcacggagatagctcctttgtgctgagtcatgactgaatctgctgagctttagtggcttggtggattctgctcataaagacagaggatgtcaatgaaaatcatgctaggctcagcataagaaatgtgcctctgccaaccactgggtggcgaggggtgaggtgaggcccaccgggtgtggcgatgagccagggactggtgtcctttgtgctgcatcctatacaaagtggctagtcattctgctggatgtggtgctggcgacttggctgagtgatggcaagactgagggtctgatgccgcagtcaaagggactcactcaggatggaaaggccgtgaacttgcccttgtgcacaccctgagggctgactccgagctgaggagcagggacagggaatgtcactcagtggcaagcttaggtcagagcagtctcttggggcacaaccaaaacagtgtgcattccacctaattaacctggggaagaacaacatgaaggcctgagacttcatcctgcactgctgtgctccagcgcccccatctgtttggcactggtaagaaataaggcactgaaagaaaagaaccccatgtgtccagcacttccgcaggcgaggtccttgctttaagactgcactttttacacaatattcaagaattgtgttgcatgagaaagtcttatcgagccgcaagaggcgactcggcgggaagtgacaggacaccagactgagggtctcctttagctctggtctgctcaaggcaaacgttcttcctaaagacagtccaagctctccctcccttctaacttcgctttgaaaccccagccagctcagcaactaattacaaaaaaattatgtaccattttagccatttttaagtatacagttcagtggcattaagtatattcatattattatgctatcatcacctttatctatttccagaactttttcatcattcccaacagaaagtctgtccccattaaacactagctccccattctctcctcctcccagcccctggccatcaccgtgagtttaactgccctagggatctcatgtaagtggaatcatacagtacttgtctttttgtgtctggcttattccatctagcataatattgtcaaggttcatttatgttgcagaatgtgtgggaattcttttttgaggctgaataacattccactgtacagacagaccacattctgcttatccattcatctgctgatggacacctggactgctgcgaatggtgcagctatggacgtgggtgtataaatatgtgctcgagtttctactttcaattattttgtgtgtaactcagaagtggaattgctgggttatatggtaattctgtgtttaactttctgaggaatcaccaacctgttttccacagcggctgttccattttagattcccaccagcaacgcacatgggttcctatttccccatatccctgccaacgctcgttgttttctgttttgttttattctgtttttttggataaaggctctattctaatgggtgtgaggaagtatcgtactgtggtttagatttagcaactaattttaagaataagcttccctgccacagaataataaatatcaatctgtattgatcattcattaaaggtctttatgaaccaaaagtcgcccccaaaattcttctctaaaactgaaaaggccataattggctgtaaggacatatggcagctgcccatgaaaagatggcaaaaggcaggcctcttccaaaatgtctaacagcgatatgtattttcatgtaacttgtcccgtgacagagcgtatgttgtgttgaaggttttcatcaagtttggcccaaaggcttcagagcccaatccttttttccaactataattaacagcaacttaaattggcaaataattatttatgacgtttataaagtaaaaacagttactaaactctttgagatgtggtagcttgaacaaaatctcacaagcgagaaaccccagtcaaaggtctgggtgtaaggctgtacatgcaaaacacacctattttaaatgccattaggcttccatgcaaagtataacctacatttctcaagtctaagaagtatgatagctgctttgaggatttatttaatctgatgaaaatcattctgacagatgctgttttgaagatgcaacattattttctctcaggaaacagagagtgaaaactatcaaccctgcccgccccatatcctcaggcctttccagactttaaaaactacacttatttaaattgaaaagaactgcaagccaggcagaattagccaggattagaatccagataacacttcctatacactagcagaaactgcagctttttcacacccagactaagcagccacctgatgtccgtgcacgtgggtctctattgtccatctggcaaggaccacatcaaactcttaaaaggaccctttgtccttaacaaaagtttgctattacttattttctaaattttcttaatgaagatttataccttattggcattctgtggaaactgcagacagacaggataaaatgccagaaacgctcagtgactgagtaaccctgtggaatgcagatatcatcaagactgagtttgatggtctcatctttaaaggaatgtggaaagggctgagaaacccaaattcatagttttaaaacttccctaaactcccaaacagcaactatttaactcaatatattcaagttactgctaccccaacatgtaactcatataaaaattgagaagacttttaacattcttttgtgttctaaggctttacaccctccctcatcatcgtggtgctctgacagcctggtttctgccccagttctgagaggtgtaaagcgatgcactcttgtgagttagagctggacaggaggttccctaccaggcagacggctgctgcaatctataccttcatcctttcgcagttgagagcttaagggccttcagtgggggccgcctggatgtctcccaggtgggccggattctgtctccctgcacttagtccagcgcccatcccaagtctaacgctcttccacaggacagtcctttggtatttgaagaaggctaccacaagcccccagaacatccctttcccagactcaaaggcatgatttcaaattccttcactctctcagctattctcccaactgcattccagtgcggtttctagagttttgcctagaactgtacgcgacaccccacatgtacctactcagtccccacaggacaccgatattgcaataatactttcccctgggctacagagagcaggtcagccaggaaatgaatccgggctccccaaaaggaccgattgctagtaatcttcaaataggactgctactgacaggcaacttgtgaacaaagtaatttgtatctgctgccctgctccagcctggctcaccacagctagttttgtggggtccttacccttcttcccttaaccctggagagcttctgcactcttagaaaaatgcagtgcccttcttcaccccaaaataggattctgtgcaacagggagggtccgatgtgcatctgactggtcagcctcttccttcccaagcatcctggtagggattagggtcagcttagttaccacgaaggtgaattctgggatggggagaaacatgcacacgcacacacacacacacacacacacacacacgtgcgtagtagtagtgaaactgggaatctggtcaaatctctgatcccactgaaagtaatcaaaatggcagcaaaggcattactggagagttgtacgtaacagaatcattttcatgttagttttgacctgggttcatggaagtctactcaagttatcctctgcaaatgctgtctccttttcatgtaaatgtactctatcagcaggaagcatgtacacagaaggcagggacacatggcctttaataagccactggtgctctattttccctaaaggatagaaatgatctcaggttgataaaagctactgtttatcaatcaccactatgtactatggaccaggtgctgagttaggcgctccccttagaagtgctgtatctaactctcttggtcctgtgaggcaggaactgtccatttcacagattggaatggtaaatcagaaaggaccagtcatttgcccaagggttgcacagtaataagtgctgggaaccagacttggaacgagggctgtatagtgcatgtaatcttggctccaagcccagtcccctcattttaaagcagagttttagcttgtcttctgtatatgatttagagatgcagagttttaaggtaagcaatctaaatgtaacctgagggtcctttattcaaccagacagtacaatatattcaaatctacctaaagatttactttctgacttgatagtggattttttttcctgaaaaatgatcacttatgtctctagcatttaactagcatacaaagcacttccacataaatcattagctcatctgagttccttcggcaggtgatgttctattttacggaggaagaaatggtgcctcagagaggctggaaccttgcttggggtcctgggggtggagcccgggaggaagcgcaagggctgtgctcttcagtcgggtcgtctgagatctccaccatctcagacgactctgttcctcagtctcgggaacaaaatgcaggggaggcttcaaaccatttaacagattcgaggcagccgacagggccagagacgattcagaaccacgcaaaggagggaccgtggcaaatggacaccatgagtgtgggctagagtgttggatgatccgggttcaaatcctgactctgccagggacaagctggtgagctggtggttgacttttctgaggcttagtttccttgtctataaaactggacagcaacagaccctaccttcttaggtgactctatatatgtgcatacacacacacacacacacacacgcacatacacacagcagaaagcaacagattctaaacagggtcgaaacacagtttccaaatttgcttctaggctgcctggcgggctctgtgctttcctgaggagggtgggcaaagagactgcttttccagggtaatgaccttgagaactgggccgcacctcaaatcaaaccctctgtcagtgcagaagaagaggcccttgggcctcacccactgtgtgctgatgaaaggtagtcacagtgtgtgcttagcacttgtgtaacagagaggacacgacactagagcactgcagtgggaggacagggtaccctcgatcagcttctgcccatacaaagtgaatggggctgggggctcttctcatgcactgatgaagggggtgacataggttgtggcccagcacatgcgctcattgaccgggaaaagcagtctcctcaggaaagcacagagcctgcagggcagcctagaagcaaattccaaaactcttgttttgactctgctcagaatccatagctttgtgcttccagagtttacagaaaatatattcccagctggggtgactttttaaacatttcccagtaagtcgatggaaaacaaatccgttcctgccatttttagttcttgaaataccttcttggcttggtcttaatttatttgggctattaattttctggacagcaaaataataattagcatggctggtgagcagagggaaacgtctcactcgattgcacccagacatttctggataacatcattcttcagagtgtgacagtcgaggctgtctccctccttcagcctggcttcagcactgacaacatttccacaagatggcactgctggtcctctcagcccgcgaacgctccggccagctcagccacctcaaggagaaatggaagccggccaggcactgcgggcgagggctgctggcacctgggcacgagggtgccccttctccccaggagtggctaattgtcacgagtctgaccaaaggcatataaaactcaacttcagtgtcgtaaacacaattctaaacccgagagaaaataatctggaacctaattccttctaaatttggcataagaaatttataacatttttcaaaagggcacaaccagaggtgcttttctaggtgagaatgcttgagctcatgttcacattggtctaacagcaccttctttgcagtgagatgctgttttcatacaactggaatcagccttcaaatccttcagtgaagaggctgggacggcaatctgccccttcctcagaactactgcttccaggacactgtgatttcaggacaaaacttcatctcaacctgttcttctgggtctgggccaggtctgggtctgtgtgggaaggatgctctcatttgggggttctgaaatatttctctccaggtagcattccacccacagatatttggctaattgttgatccagatgtcaaaacttcacagagatttttttttttttttagttaggaaaggctaaacccccaagttctgagtgtgttgggtgaatagggctcatcagtagatgacgtgttccacactctgcatgtagtgtgaaagccacagactgggagtctggtttaaacaggagggaaccttcattttccctctagacacagctccagaaagctcctgtgtgcccagcactcttcccattccagaccacttcagtttctggcgtgtggatcttccctccccctcctcctgctcttccctattgtacccctttccctggatgcaaagaaggggaaataacaacaggaagtgttaattacccttctcacatcttatggatttaatacgtagtgatggtcctgggccactgagagtctcaaaattcatcacatatacagaagcgaccacatctgaggggcacagcccaggcaccacttcctgaaagtgagccagggaatagggggtgtggcgggggggaggcttcagcctggtgtagaaatcccagacattctgctgccatctccacaggagtcataggcgattcagaaccacagacaaaagcagtgtcatggcacgtttgagggcttgggcttaggaaatagatggttctggggttgaatctcagttcagatgagcagcctctcaaagcctcagtgtccatctgtaagatgggaatgattcctactttgtagaatagggagtttaaagaaaataatgtattcactgtgcttggaataggcctccactgacaagctcatgtttagtggcaataagtaatgaattagtttcctatgtaaagacagtctagaaattgctttttgtcttctaaagcataacacttcctttctctctctctcatttctttcaagactggggaatttcagagtttctcagggcttctttgaagaatgccagcgggcccaccttgagtttcctcactcctttgttctaagcattgcgctgtgccatggcgcagggtttcagggcattactatgagaaaaggttcccccagcaccaaagagtgggaatccctgtccacctccactgccagcagcctgaacaattcaaacagtataaagcagcaaaaatgactgcttcctttccttaatgaaatgttccagagaaggtaacttttaggaagaatgtaggttatcattaagggcaaggggcaaacttaaaaaaaagggtgcatgtttaactacatggcaatgtggaacatactggggggaagcccgcctaggcttagctctaaagctacattgttgggagaccttggctgtaggtgggccatctctaaagacgctagatcaggcattggacatagtcctttgcagtattcagaaaggctcctggcactgccctaggaagtgcctgctcaccgtgctttattacatggttagctcgttacaagacagatgcgcggctgtccagcagggcctgaggacaattggtatgattattagtctgtataacgatcatctatgtattaaaaactttacatgttgcttgatttcagtatgtaacatttaccctaaaaaccgttccatctttgattctgaacacgtccacgctttagagtcactctttggaatttcaattatggggaggtgctggtgactgcttaatgctgattagacaggtgctttaaaaatcactctatttattgtctatattttgaaatgcaatcttcaggctcaagggtcatgttataaatggtttaatttttgggaggtgggtgtccatggttcaaagtacaaagtattttaaataggataaaactatggtggctctaaaaaggaaaatgatcatgtaggtagaaaaaaatccaacaagacaactgtcattggaattcctattagaaagaagtacacattaatccaatacagacaccaaaaaactcatctggtctgagtctacttccatctccggaagcacaggtggctgaccttaaatgggaccagctgtcactaggatgtttttgtgtcgaacccagcaacagaattagagagatgccagagttaacttgcactgaggatactttccagccaggtgtctggctggaaagtcacagagctacgcatctagcaagaatcaaagcctggcctgtgagaaccacgcacagtgtggactcaggtcagggacactgcatgatggacaagggctttctgaattcctgaattcaccaggaattatgtccttagtccacctttcccacacacagcaagggagggagttggtgagctgagagcacagctactcaccagccagccaggctgatgcagtaagtgtcctcagtggtctctggatctgcaaattcaactgctacctgactggaaatgctagctctggggaccctcctaaggcccttcctcagatcataccaagcacttgggccttttccagacttagcaaaaaaaaaaaaaaaaaaaaaaaaagagagcaaggtcaagtagacagaaaactaaactcacaaccaattctgcttactttccaaaaccagctagtgagttgggataacttacgttcaacccaacaaccctaccttcacccacgtttatagcaaacaccgccgagtattagaatacaatgggagcgcagcagggcaggctgtggtatagaccagcatcaaaggcccctaaagtttgggtttcgagaaatgcactgtgagccactaattaaagtcttcactcactccctgatattgactattcatgatgccctgatctctagtgactgggtctctcctgggtaaattaatattcagggccctaaggtttattgtggtttatttattagttggtttcattcatttattcacacacatactatacatatatatgtagagtgtcattctatctatcaatcatccatctatctgtcaacaaaagttctctgaaaaaggaatttggaggaaagagactttattccagtgaacagtttgcaaaccagggagacacagcctccaatataaaatgaaggtatgttccaaagaacaaaggaagacttgggttttagagcaaaagttcccacccaggttcccaatcaggtctgtttattcaaattaaaaaaaatgaaatttgcttagttctgattggctgatacggctgagtactggttggttggttcaggtgagctctaaaagtcccaaagataaaaaggtgcaggtttgggggggatctcagcatacctgtatgacccctagtcggcaaatggccacttggctctatttcaaatctggacccagtgagccactaaggatctatattggaagactggcccttccaggttcacatttgttcacatctacctacctacctacctacctacttacctatctgtctgtctgtctacggtgtttataagtatcaagcatgcctgaaaataaggaagcatttgcacaatctctggagcatctcctactttttcctgcctgtccagttgctggagggacataggagcttgtctccgcttcttatcactgtcatcttcttcctcctctccactaacaggcatttggtgttcacacactgtataggacgctgggttagggactgaggtgaagactggtcccagagggctccctaaatagcaagaggccaacaggccacacctgtgaggtttaccagaagctaatgcgaaagcaggtcaccatgggtttctggaaaagtgggctgtctctattttgatgtggccggtctctgtggcaaccccatgaaaactaagaatgtccttattgacaggaaggacttccacaagactgatcctccatcagggatgagaattcccccagagctattcctgaggacatgcagggaaccacagaatctctgtgaacttggtgaatgagcctttccagagaggaatgaaagggcaggggcaggaagcaaggggaattccagagtgtgctgcactaggccccaggcccacggctctcactccttcctgcttctcccaaaggttccctggggtgtcccctgccttgagggagcttcctttgctttccatgaggacagccagataatatgctttaccaccagcaaatctcaccagtgaagatatctatgtgccctgttattcacaaagtgaggaggcagatgctggatgatggacagagcaagctgcgaccctgagggcccctctccgagctgagatgcacctggagggcacaacctcgagcatgaagagggtaaccagaatggggccctgggtgggcccctccgcgggcaggatgtgacatacttctagggagcattagggctcaatggaaactttccactaagacgtcagaggggaattgatgtgtagtgtataatcctcactttgaggcgctatgtacacgtagacatctacatgagagccttccttcttccacatggctgggcagataagtccacccacctgacttctgaggcccactgagaagtgacagaaagtgcaagaacaacacaggtgcatttcaggagaactgccaccaccatctctaaggacagctgcaagccaccctgcaaatgttaatgaattagaatgcaaactaaggttggggccaaaggaggaactggaggctctttattctccttttcacatctgctgggacctgtaggaaggggagtcgttagggatgggagaagggaaggaaattttcagctgaggcacaggttctggtggggagttctcactggcactgttgcgccccaggggcagcgtggatgtgtggggcatggtagtcagcgtgcatggatctgtgctcaccaccactgtgcctgggcgcttccatcaggtaaatattcactgagcaaccacccagtgcctgcccagtgctgggtgctggagacccaggagccaccacccagatggggccggccttgctgcggcaagagggtgctgggctctctgcagcattataggactcaaggctgacttgacctgctttgcaaactaacccagggcccttgtttctctgggtcacgtgctataggtaagatggccctactgttttacattctgttatctcaaaccagaatacattggctgaccagcacaaggcagaatgtgtgaaaacagaactttcccagaaaatctgggccatggggcccctgctctgaatagacgggtgtgaaatgcctgtgtctgtgctgttccatgcatctgatgaacaagctgtcaccttagaaaccagagggaagaagcccacagagaggtgaacacccaggaggcaaaccatggcatctggctggggcatccgggtacttggtcaagacctgaagcaaccattggctatgagggcttatttcccaaggaaacaaaaaacgcagtgtttaaagtgagatacatgcataaagcacccagagaagtcatctgcctctgtgttgcttgtttaataaaggcaggtgaagatggaacaggagcactaactcacaacaccgatttaaaagaagtcagctgtatcatggagaacgcaagtcaaagaggagttcttttcaagctcaagatgcaatctgctgcttttcctcagcatttgcctcaataaggaaccaatttgaatatttttaaacccagcatctttatggttcagtaacggggctgagagccctaaaatggttttcaaggatgtaagtacaaacatactgtgcattgtagtttccaataatgattgcaatgtcagatgacattgtatttgtcttctatcagtttcttaaaataaataaataaataaaaaggttgagggggacggggggcgggggggcagtgggtggtgcaaccaatcccctgccatctcgtctctgaccagtagagggagaatgaacttcattcagggcagcaaattaggcctcaagttatccctaggatgatggttatgtccctgattccctgggacggtctgggttcaggcattggtcctggtgttattactagcagtgctttctttcactctcaaagcatgtcagactaaatatgctgcatggtcactccaagctgagacacagaattctggtatgatcctcaacttttccgggacacttaagtttcatttttcatggaagaaatgctcggattgcctgtgcttggttccaccttgatacttgagccagctgataaacagcaacttcaaggctggctcatgttctctttccatcactttccttcccctccaagggcaggacttatactttcccagctgtgttgccataagaacttcccaacatggctttaggcttatcacaacacagctttaggcttctgcacgcatggctccccttcaaggtcaaggaccatggtggaatttgttgtgtgcccagcgcctggcacatggtctggtgcgcacacatactcaacaaatgctttgagcaccaaatgacatcaccggtcagcgaccctcagcttagcacaagtttgtggtcgtggccaggcagtgaatgaaccagggtgcttagctggaactgtttgttgctcatttcttaggaatgagtaactctcatgccctgcccgcctcaaaggcttgcaaaagaggcaaaagagcgattagagatagtggatttatttttgtgacccgacaatctggctgagctggatctgctggccatgggttgatatctggagtccccaagcaaatgggcccttcctccagcttttgccagactgacctggaagattggcttttctccctctttagagggagctcaggctaacaggtacttcttcagatcttttcaaggcaaacttgagaatggtgatagagccatgagctgaagcttaaatgataagcacaattagctagaggcggtaaggaaaagagggatggggtgttatcaatgaccacattcacgagcctgaattaacgaattcaacaggaaaaactccatctaccttctttatggcaactcctggcagctgccaacaacagctggatggctttgcaggactcttgcctaaaccagagaaagactaagcatcaaaggtagctcatcttgttaagaaagcatgtctttttaataaagtgcgatgtcactcatgaccaaaaaaacccttgcaaaagggacagtaacatgcagacagatgtgcacccttaccctgagcataaacgatctggcatgccttgcctcctcagccagagtctcaaatgcctgaagaatctgggtcttaagttttcaactttcgtctccttacctaaggctactccacaatttctgggtttagtcatctgcaagtgaatgctgggaaacagcctgtttctgttgattccccttatcaccaagcacctaggagcagggctctgtgaggaatgactcactctgggcagtaggacacatcttacaaagcaggggtgctcccaaaatagggagcttacttgttgggacacagtaagatgtttttccctttagaaacaatatgaatgatgcttaggttcctaaactgtctcagaagacacgtaatccaagtgtaggctgtgaaatgctagtgtgctgagttggggctgagagctgggcctggctggctgtgggcttctacagagtagttgcagccctgtgcacaggcagggggggtgtcaccgactcgcatgtgggcaggtctttgctgcgcatcaggtgctttaagcttcggaacaactgtgcaggattctattttagtattctggaagcatcattgaggaagtagtccagtgaagttagctctaaaaaaactctttactctaacaattaaaagaaatatgccaaaggatccataagggatgaataaattattaaactattaagaagttgctataaatatgcagtgttaattcaataattcataacggactggtacaacaagattttttaaggctcataaaatactgctggctttggcagtagctagtgtcctggggctcatgccaattgcttctttacacagcagcctgggtgtggggggcacagggagccttcccctggctggctgcccaaggactccaggtagaggacagcgcagggcgtggctgtggggatgtgccttcactgcctctccagccttgctgggggccaggcactggcttgtctctatggcttcacaaaaaatacagcagcggtgaagagggggagaattcacagcaccatgctgtggcagaaagcagcatcccgagggctgggcaacctcttgcctgaacctgggaacagggcgtcctgcctgtcaaataccagccagcctggtgaccttcatctccacaggtgcctttgtaccccagagtttcctttatagtccctgatctcttttacctggagcccttggggctacataggtttcagaattcaggatttttcaagttttataaaggcaatatgttataaaaatcatatatagtgaacagttctggaggggcttgggcagcaccccatattcaaacccattaatttttctacagcaaaatgtatggatattacactaagtaggatttagggaccataaatatcctcacatcagctcaatttttgccaccatgagtttcagtgtgaaaacataaagccctctgcagttttctgagtgctctggaatgtgtatttgccttggagacatgggcactttccgctcaccacttcctatgtgtctctgtgctgtcgcccagtctgctgccaagaaagggaaatggattagaaacaggtaagacggtaaaactgtcaggaggtaaaaagattactcctggattacatggagatgccatggtcagctctatacacttatctgtatagagtaaaattggattcattcaattaagtgaaacccttggcaaagcagaatagaacaaatgtaatcagggaattttccccaaattgtatcttggtcttttctgggttaatagaactgagcaccaacacctgtcttctgtttgtgtggcctttcactgattctagagcccgttgcctgtgatccctcagtctttcctgcgcagtgtacagggccaggagcccacaagcatcactgacctccttttcatacaggtgagaaagcagcttagaggtagacagtccctgtggtcgagggaatgggaggaagtggagccaggacaagcacgtgggtcctcaaactttctggctagctctggtcttcctacacctgtcggatgcacaacctcagaattgtggcccaaaatacattctgcctggctctcatcctgcaatgcaatttgagtagcctgtggtcaactaaattctggaaacactacttcctgtatcctcctctgagagactgaaatgccccttagtgtaatggggctctgagtcatcttaaggaaaccagattaacttcctttcacccatttcctgatgcgtttgaatcaggaagccttttgggcagaacttccattagcatcagcccaccgcggcccacactacacacggtcgtgacacatgtattaaaggctgagttgcaattgtgttccatattttatgtagaggtgaaggtggtttacacattttggaaagagttttacctcggaggctaaataggggtcacagtgatctagtgggaggcccaggctagggaatccatttctccatcctccttttctccaccactgggtcacgtgctgtttggtcactggaaggacaagtctgtgtggcagaagcctgggctctctccactgctgtgtgagaacaaggctgtgcatttggccccagcctttcagctgccttgtcatttgtgatgaaacagaagcagttccatgcagggccacatgccctcatggtgtgtactatctgggcgaaacctgtcagacaacgggcatttttcatagagaaaggagaactcaactttggtctaagatgctctctgccctcctgcagttttcctttcctactcagtatcatctttcatggggagagaagcagatttaaatgtaaggtgcagtcatacctttgagtgctgattttcttttgttatgatttgatatacctatgtgttgaaaaattccacaaattatgaaatccttggttaggtgggtatgctggaccaggtgtgcttggtgagacattagttccatgagccataaaaaaagtgacattcctttggggatttactgcccctgaatcatgtgagagccccagaaacaaagcatttctcaaatatgcatcattttaggtagatgagaaagaagccacagtcacctccgccctctggactgcagagagcttagctcacatcggcatttgcatccaacagcacaacatggaaagcagtacacaacaagaacaggcagaagtgtcttcataaacacattttgcctaaatattctgtattaaccacagccatccacttacagggtgttaggataacttttagttctaggtgcttgactataaaatgatggcgatacatcaactactaatgaacatactactaataatagctagtatttctttctgactctgggcccagaactattctatgtactggagacacattaactcatgtaatcttcacaacagtcagcttaggtaatattattaataatcacagtttacagataaggacacatgcacagagaggttgaataacctgcctaaggctacacagtgagtaagaggagaagctaggaaccaaactcacaagtgtgacaccgaagcctgggctcctaactgcagctgatgctttcaaatccaaacctcaaatgcattaatgccttatatggcttgggcacaatcttgagaatttattcaaatgttacctggtttgtcagaaaatcggacagagatggacttgttaagacaaactcactttactaatcagtgacgaggcagttgagaaacattttacctggaagaatttcttgtctcttgtttatgagacaaaaatgatgatcggatttgataaagacacacttttactaacctagaaacagtatccaaatttaatacattaaattgtacctaatgaagaggccaacagatgtgtgcacctgatcctatgctgtaggtgggagcactgccctcgagaaaagggctcagcattccagaaaagcccagaaaaacccgatgcacacggcatgcttcaggtccatcttcatgaacaacacgaacatcctgtgtcctcccctaattaggtaacctggtcacgcgcttcctcctttcttgatctgaattcccacaactataagagggaaggatggcaggctaagttcaaaacccacatggagaagtcagaggggactggccttaaaaaaagccatgggtctgtccccaagtcagtcggccagtttgcaacgtctgaggtggctggggctcaatgtcaaatgaataatgaaaactcaactgggcatttacatttaagccaagtgctatgaaggggaaggccaaggtgctaaaggagcacacagcaggggtttaaactggtttggagggccagtgagatttcagctgatatctgaaaggtgtagcttagtcagctgagcaagtgttgagaggcagacatgtgggtgggttcgggaatgggagaactgcccaagggtgcattctgccttttctcaacagcagcacaaacttgagtaatttaaagattcatattcaaaaccccgtaacaatgtggccccagcactgagctgagggcaggagagctggtggtgtgatgcacgggtgatgtggtgcataaactatgtggtgcacaggcagtgtgatgcataggtggtgtgatgcatgggtgctgtgatgcaggggtggtgtgatttgcgatcagtgtggtgcacaggcagtgtgatgtgatttgtgagcagtgtggtgcacaggcggcgtgatgtacaggtggtgtgatgcacgggtggtgtgatttgcgatcagtgtggtgcacaggcggcgtgatgtacaggtggtgtgatgcatgggtggtgtggtgtgtgggtggtatggcacacaggtggcgtggcataggaatcatgtgatgcacaggtgctatggtgcaaagatggtgtgatggatgggtggcactggatgagtactggctctgctcatcatccagttctcttttagattaaattctccatgaatcacattaatttggtgcctcaccccatgctgtcgctacctccaagtggctctaattcttatttaggcttgaaattcttaagagttggatgctacactgaagagctgaatcatcctttaatattaagtacaaaggaatttcacgggcaatacaaacttgagcattgttacaactccaggcagatataccaacaggcagattataaagggcatatgctgtcagagcagagaaataacttgggagaatataaactgaaatgaccactttgaggaggaaaatttttaaaccaaattattaattcttctctactctggaattgcttaaaagattttctatcaaatggctttcctacattttcagtatgacccacaataaaaacctggatcattttacattgtgatgcagtgggcacaagtgcacacacacacatagagacacacagacacagacacacacatatacacacacagatacacacagacgcacatacacacatgcacagacatacatacacacacacatgcagacacatacacgcacacaggcatacacatatacacatatcagacacacacacacacacacacacgcacatatctccctaaacaaacaattctgccccttgtatcctgggatgcactaatcccatgtaatatgggatctgtatggtcccatccctgctgatctccatccactcaactgacttcatgacccaccaacgggctatagcgtacagtgtgaaaagcacagcgactctgaaaccatgttattaatgataacagtttccacacttccacttttctttgtcatcgtaagcaatgggggaaagtccttgtgcggttgtgcaggtggactcctacactgcaggcccatataggaatgcgtttggggtcaacagataaggctctggatgctgtgaaatgttctcagcacctctaactagggtgcaggagcacaggagcacagctgtgcctgttgttgggtgagtgatttttctgacagagtaaaaccttatttcgttggatttcactaatttgaagttcatgttcattgggtcaaaggttataggcaacataaacaagatagtagaaagaatattaaaatcaaaagaccctcaatctacaaataattgatacgttcattacaagtaatcctcctttgtgctttcagtcacatctcctctacgaggaattcacctggcacctctggaatagacaagcatgtgccatggcttgatcatgaaagtaccaccatatttctttgtatttaataatctggatttttaaaaagcacatctgactaccattcactataattaacacaaatagctgaagttctactgtatgaggtatgcattataaatgtttttaggtttgctattcaggacgtgtacatgcattcctataaaaacccaggtgagttactggggaaagaagatgaataaaagtccgactatgcgatgctgcagccgtggagctcacacagtgtgactactgcatggtgtggtgtgccagacccaaacgcaggacactcccagagtaacgaggtaggtaagggagcccagtacatcaatcccaccactggggagagcttggaaaggattttcaattccaacctcattgcttgggtgtgttcaaaacatcccactgcactgcccagagggttgcctcgtggtcagatgggtttggcaaatggttaaacagggctgtgtggctttctccgaggcatggtctccaggccaggtcacaagctaaggtgcataatgaatttccaggagagaatcctagaggctgcttgcctctgaccacatgacaggaagccaaggagcaggcttggaactctgctgcacagcagggctcccaccctccacaagggcattgaaaatgcgggcaatggaccagaggctgacagttacccacctggaacatgtcccagggaatacccccaaagggaagagtgctgggcactgcagcccttcttgtattctttagggcaatgatgtcctgggacccagggcatcggtatggattcacctgggactggtcagaatgcacatttctatatactacataagccttcctcaaacacagaggcccagcgatctgtgtgtaaccagccccaggtgatgctggcgctgctcgaggctgattgccaggctctgtgatgagggagaagtgcccacataaaggggctgcctgggagtttccgtcacctccaccttcagaaacaaaacagggaaaaatcacttcctcagcaaacgacccctccccttccctcggctacaaaacaatccagccccgaagcctcagggagaggtggctagggcccttctgagggcctgcttttggccaggggccataaggaagccttcacagcctcaatcacaccaaatcccctgaaaagtcctgtaaacggatatcacaggcccatctccaagatgagaagctgaggctcagggagttgcagttatctgacccaagccacagaatggccctggcagaggcaggtttagctcctgttctctgtgttcaccccactgcactgagaggcctcctgggaaacgtgtccacagccccaatacggacagaaccatgagggggccacagaagcctttcatggggcttagaggccacagagcgctctgagtgaggtcaggaggcctctggcatcgggcctggaagtgtggtgggatgatgggtgtgctctggagggtgcagaggaaggcacgagggtccacaccaatggacgggctggtgggaagcacagagcctgggagggtggctggagaaggtgccctgaaggcaggacgtgccttgacttctgcgggtgacagggcaagcaggctgggagtgtccttcagccctgcacctgtgcctgagtcccaatcaccgggtgttaagggacactgtggagtcagtgagaagcaggtatgaaagggaggggcaaatggaattgtctgggacaactgaaggtatctcaggcatctgcatcaagctgcccagttagcaataccaagctgagccaggggaagtggtgagggctgaggggttgtccgcagaggcacggtgtgagaaactgtggctgaaatgaatttaccctggagtgtgttgtgtgaggacagaagagacaaagagaaaaggcagtgcagctaataaataacaactgaggtctttaattaaacatcagtgaatctaagacttgaactcttgaaacatctgaagttgtcaacgtgaaataaatatggccatggggtccacactcccatgttttgaaatgaggggagagaaaagggttttgctctgctgtacacagcaaggggaaggtaggtgtgagcagacctcgggatcagcagggccaagagcagcgcatggctcccagttggtggctgaagtccgctcacccggggtggcctggggcttttaccttcatcagaatttcatttgaactttgccctgatgccaggcgatccatgtctgcatccaccctctatgaaggccagcctcagacagggtgggactggagacaaaggtggtctcaccggggcgtaactgccctggtttgaggaaggagcagtgtttacaggattctcctaatgactgcccccacactggtcctctgaggacacacgtgcacctacctccagcgtttatgctctgtgagagccataacttctacgctctcttactctatcggcattaaaaatcctctgaactctgacagcgcttcctgtgtttcctggagtcggtgcttctcaccaccctgccctccaactgtctatccccatcttcctgatgagacctcagccaccttactctgggtgggacgtctgtttactctttctcacacagtgctctgaatagagcctcaagaactgctgattcactggcttcattaaacccaagtttgggactcaagagcaagttagtttttcattgaaaaatgacatgtgtctagcatttgcaagcactgcgtgggtacaaagtaatatactacataatccttcctcaaacgcaggaccaggcagggcaggaaggacttgaggcaggcaaccactgtgtgccaagtgagaggctgttctggctgaatttcacccccgtccttcccagcaacacattcctatgttgaagtcctaactcccagaatctctgagtgtgactctacttggggacagggcctttaaagaggtgattaagttaaaacaacatcattagggtggaccctcacccaatatgattggtgtccctataaggggagagcaggacacagacaggcagagagagaagactgtttgaggacacagggagaagacggccatctacaagccaatgagaaaggcctcagaaggaaccaaccctgctgacaccttggtctttcaacctccagaactgtgagacagcaaacttatgctgtttcatccacccagtctgtggcactttgttaaggcaaccctagcaaactaacacagcaacacacacagcatgtgcagaaagaattcggatgggggaagctcctgtgggctggggtcataaggtaaggctttgaaaaagccgcttcagtggggcctggaaggaccggcacaattcagggtatggagggactgggagacccctccacataggaagggcaggagaggtgcagaggaggactgagcacggtgtattctgccgagtagattctggcctctcaggtcctgattcatggaaaaggtagacattgatgtctgtgaggagggctggatggggtgggggagactgggcagggccttaaatgaccggttacaaagggcaggaacccacaggaccaacatggcacaggggagagagttctagactagggcaagggaagccctgtgggtctacacattagccttgaagctggcgggaatgcccttagcttctcagggcttctgttattcagttgcagaatgactacattgaactctttcagtggttatcaacttctctgtctgtagcagtagatcctgttttaaaacatcaaatctgaatggaacctcaagatatcaaatggatctaggtggggctcctattgaagtgggggagggagaagcctgaggtggaccccaaggcatctactcattagtgcaggcctccatacgacacatgtacccatgaactaggctgagggaaaaccaaccaaccagccgaccaaccagccaaccaaccagccaaccaatctgccttacatctttatctctgttgacatctgactgatatttaacatgccctctcaggatgaactccacaggcaaccttcccaagccaaaggctccataatcgattcctaggaagcaaaggttacagggtggggaaactggaatctcagcaagacaacctaacattggaatcgaaggtcaactgactagggcaagactgagacaaggtgaccagtaagaggttctgtggctaaccaagtctaggatctgtggcagtcagagcagttccttgtgggagttacgttccaggcacgacagcaggactgggctgggcagcagaggaggagatcacaatgactgattttcaagcccaggaggagcagggaatgagggaggcagaagagtgaaacagagaaccaccaccaacagccattcataacgtgctttatcttgctcaaggctggcatcttctcatctgacaggggttactgttttacccccactttccagctaagaagcccccctgagagctgaagtgttttccacaatcacacaggcaacaggtcccaaagctggtactcaaacccaagtctcctgccccaagccctgtgcactccgtccactagaggctgaggtaaagctggaccagcaaggagccgtccctccagccagcaggcacgcctggtgtgctctggcggggaagcggggctgggcaagtgctgctgtgtttattcctcattcgggtgatgacaaaggcgggaacatgcaagttctctaatggacggtaaacagaagaaagcagaggtctgagaactgaacgtcagggagcagtcaagatcccatcaggctgcccatgtatttcctcttaatatttgacaatgaaaagggtaattaggactcgcagcaaagcagccttgcaatggaatcacttaaactaggccgtgggttctttccacatggaaagggcatatggggtgtagaaccgtgagagtcacgctgagatccacacctttggaaagttgtctgatgtaataaaaaatgagagtagacatatatgttttgacgtaacacagatctaggaggtataaggtaaagattcttaatctaatgggcccagaaataaaattcaggacacccatgaactaggctgggggaaaaccaaccaacaaaccagccaaccccacatctttatctccactgacatctgactgatatttagccggccttctcagggtgaactcagcagcatcagcagtgcctgtaattttttcatcaatagaaatcacagatattaatagttttatatcacattcctgttgttgcacatacctagaattaccgttgacattcatcactactctaaagtgatggcagtgatcagacctatcaggagaccttgttattaaatcttaaaaaaaattacaatttaaagtaatattttgataactgtacctcatacttcttacggcaagaaaacaggtaatacaaataaaaacaaagtcaggaaaaatatacagaaaaaaattcaaaaggatttgaaaagtgaggaagcatagatatgcagatacatggtgatatggggatctgtgtcccaccaattctcatggtggaatcataatccctaatgttggaggctgggcctggtgggaggcgactgcatcatgggggtggatttctcatgaacggtttagtaccacccccctggtactgtcctcacagttgtgagtgagctctcgtgagacctggttgtttaaaagtgtgtaatacttcccctcttgctctcttgctcctgctcccaccatgtgagacgcctgctccccctttgccttctgcctgattggaagctccctgaggcctccccagaagcacaagttgccatgtttcctgttcggcctgcagaaccatgagccagttcaacctcttttcttataaattacccagtctcaggtattcccaggtatttgcactgctatagggcaaaaatggactaacacatacgaatatacagatatgcacgccataagggtctctgtgtcttccagagttgtgccacaaatgtgacttaaatttgcttgtgtccaaagtgcagggagttatatggacagttgctgagttcctgtttttggaggagaggaggaggccccaaatgtaaaatgttggagaggttaaagacacagtagcctgatgtcccttgggtttggtccttggaaggatgctgctgtacttgcactagggagtatttgtgaagtaataggaatggcagccagattacagggcccaggacagcaacaggagcaacttccaacccatcaggctgatgccccacccacctccaggtgccactcactccagttctaaacagtgcctggccacaccttgcaccactccacccttggggacatggagtagaagcctgagctgccgggggcttcctacagcaaaatcttctgagcttgagaaacgcaggcaaactggcaatgtcttgtgggtcaattaccaggcagttcctgaagacccagcaaaggtacttttgaagaagctgctgggtcatttctaggtacatagcacctctcagaagcaaaagaaaaatgctaagaagaattaacgcagttgttaggaagtgagtgagttaactaaggtctcaaggaaaacaggggtgagtcttccgatgccacggagagaaagggcaggctgctgtaggcagggaggctgttagcctcatttatcattcatgccccctggccctgggaactcaccatggaattccaacaaggagctggcactgaggtatttattgctttctttgcatgtcagcttgtcacacgtaacaattaatttgatgatcccaaattggacctgacaggaaacctctcgataatacaccatgcctagatttagcagagataaacactgctgttaatttctccagcagaggatgtgagtatcaacccagggctgctttcattaatttccatctcacacaatgtgggcccacctcatattggcattgctccctttagctgatagctgtggccagttttagaagtgtggtgtcctagggttgcctgccaatcatttcccattttcaaagtgatgagaacgtgacaggggacacagacattgagctccatcggtgaagaaacagcgggcagaatgaagctggataagccctgaaactgctggtaagaagataaaatgcgactaagagaaattgtgctttcaatgaacttttcaggaacacatctatcgtgcagagtaaactccttcgaagtctagatatctgtgggtagtaagaaaaaataatattttttctctccctccacccctatactaactgtgatggttagtactgagtgtcaacttgattggattgaaggatgcaatattgatcctggtgtgtctgtctgtgagggtgttgccaaaggagattaacatttgagtcagtgggctggagaaggcagactcacccttaattgggtgggcaccatctaatcagccatcagcaaatataaagcaggcagaaaaacatgaagcaagagactagcctagcctcccagcctacatctttctcccatgctggacgcttcctgccctcaaacattggactccaggactccaagttcttcagttttgagactcggacctggctctcctggctcctcaagcttgcagacagcctattctgggaacttgtgatcgtgtaagttaatacttaataaactcccctttatatgtatgtatctacctattagttctgtccctctagggaactctgaggaatacagattttggtaccaggagtggttgtagaggaacagaatattaaggatggagttctttcattggttttggggtttctggagttggttgcttaatatgattagaccccaaaatgctaaggactctgcttctaatagtatggagaatactgataagtcctaggcggaaactgtttagacttatgcaaaataaatgcatttggcactcctgattcaccgcttgtgagaagcaaggagttcactcactctatacataatacctttgaccatatgtggagaaccaaggaacataatgcagcttgttggttgctcccaagttcagtggacaaactgatgaaagaaaatgatgaactcagggattctgtctccgggcttcagaagcagatactgaacctcaaatctgctaagattgccctgagtgagagtcttacctcctgtagagaaagagctgaaattgtggaaaaacagacacaagcccttatgatgtgagtggctgacctgaaacaaaaggttcgtgcacagcctcgccaggtgtctactgttaaagtgagggcattgattggaaaagaatgggaccctgcaacttggaatggggacatttgggaggaccctgatgaagctgggcacactgagtttgtaaactctgatgaaccatttttgccagaaggaatttccctattcccagtagtggcaacatccccttcccgacccatgctgccaccagcctttgcacctctgtctgaggagataaaccctgcgctgcctgagggaacagtgatgacctcttctgaggcagttgccaggcaagataatgttgattctcctcagaatccaccccaatacctctgtttgctaattagataccaaggtggcaggggccaagtggcagcactcgaccatcaaaggcaaggtgggtgcagctacgacaatgaacggcagaggcaatgaggcaatcagaatagtctgactagtgtagagctatggcattggctaattaatcacagtgttcctagaagtgaaattgataggaagcttactgcattcctacttaatttatacaagcggaaagcttctaggtgaaatggataaaagactaatttgaattagaaaaacagaatcacggctcctcaatcaatttccagacttgagtcagtttacacacccagaaccccttgaatgaaggggaggctgggtccccttgaggaaggaccctactacattaccaacaatttatgcaacaaatctttctcccatctttccccaaggtgacctctggctttttaccagagtaactgtggattggggaaagggaaatgatcagacatttcagggactactggacactggctctgagctgacgttgattccaggggactcaaaacatcattgtggtcctcagttaaagtaggggcttatgaaggtcatgtcattaacggagctttagctcagatctgacttacagtgggtccagcgggtccctggactcatcctgtggtcaatcccccagtgccaggctgcataattggcataaacatacttagcaggtggcagaaccccaacattgactccctgactaatgaggtgagggctattatggtgggaaaggccaaatggaagccattagagttgtctctatctaggaaaatagtaaatcaaaaacaatattgcattcctggagggactgcggagtcagtgccaccatcaaggacttgaaagacgcaggggtggtgactcccatgacatccctgttcaactctcccatttggcctgtgcagaagacaggtggatcttggggaataacagtggattatcataagcttaacctagtggtgactctaagtgcagctgctgtgccagatgtagtttcattgcttgagcaaattaacacatctcctggtacctggtatgcagccattgacttggcaaatgcctttttctccatttctgtccataaggcccaccagaagcaatttgccttcatctggcaagaccagcaatacacatttactgtcctacctcaggggtatatcaactctctggctttgtgtcataatcttattcggagagaccttgattgctttttgcttctgcaagatatcacactggtccattacattgatgaccttatgctgattggatccagtgagcaggaagtagcaaacatattggacttactggtgaaaacatttgcacgccagagaatgaaaaatcaatccgactaaaattcagataccttctacctcagtaaaatttctaagggtccagtggtgtacagcctgtcaagatattccttctaaggtaaaggacaagttgctgcatttggcccctcctgcaaccaagaaagaggcacaatgcctagggggcctatttggattttggaggcaacacattcctcattttgatgtgttactctggtccatttatcaagtgacccgaaaggctgtcagctttgagtggggtccagaacaggagagggctctgcaacaggtccaggctgctatgcaagctgctctgtcacttgggccatatgacccagcagatccaacggtgctggagttgtcagtggcagataggggtgctgtttggagcctacagcagggccccataggctaatcacagcagaggccactaggattttggagcaaggccctgccatcttctgcagataactactctccttttgagagacagctcttggcctgttactgggctttggtggaaactgaacatttgactatgggtcatgaagtcaccatgtgacctgaactgcctaccatgaactgggtgctttctgacccatctatccataaagtgggtcatgcacagcagcattccatcatcgaatggaagtgatataaatgtgattgggcttgagcacgtcctgaaggcataagtaagttacatgaggaagtggctcaaatgcccatggtctccactcctgccaccctgccttctctcccacagcctgcactgatggcctcatgaggagttccctatgatcagttggcagaggaagagaagactagagcctggttcacagatggttctgcacaatatgcaggcaccacccaaaagtagacagctgcagcactacagcccctttctaggacatccctgaaggatgcagtgaagggaaatcttcccagtgggcagaacttccagcagtgcacctggttgtgtactttgcatggaaggagaaataatcaaatgtgtgattacatactgattcatgggctgcagccaatggtttggctggatggtcagggaggtcattccaagcggtctgattcaccgtttgtgagaagcaagtttattgactttatacataatacctttgaccatatggtctgaccaaggagaccatgggcatttgagccacttcctcatgtaacttacttgtgccttcaggacttcctcaagcccagtcatacttacatcacttccatttgatgatggaatgctgctgtgcatgacccactttatggcttgatgggtcagaaagcaccctggatggctagggacttcaaagaagcatgattggaaaattggtgacaaagaaatttggggaagaggtatgtggatggacttctctcagtggtcaaaaactgtgaagatatttgtatcccctgtgagtgctcaccaatgggtgacctcagcagaggaggattttaataatcaagtggatgcgatgacccgttctgtggacaccactcagcctctttccccagccacatgtcatcgcccaatgggcccatgaacaaagtggccatggtggcagggatggaggttacgcatgggctcagcaacatggacttccattcaccaaggctgacttggctacagccactgctgagtgcccaatttgccagcagcagagaccaacactgagccctcaatacggcaccattcctcggggtgatcagccagctacctagtgactagttgattataatggaccttttccatcatggaagatggcatcatggcagaaatttatcctcactggaatagacacttactctggatataggtttgcctatcctgcatgcaatgcttctgccaagactaccagccgtggactcgcggaatgccttatccactgtcatggtattccaaacagtattgcctctgaccaaggcacgcactttatgactaaagaagtctgacactgggctcatgctcatggaattcactggtcttaccatgttctccatcatcctgaagcagctggattgatagaacagtggagtggccttttgaagtcacaattacaacactaactaggtgacaatactttgtagggctggggcaaagttctccaaaaggctgtgtatgctctcagtcagcctccaatatatgttactgtttctcccacagccaggattcacgggtccaggaactaagaggtggaagtggaagtggcactactcaccatcacccctaatgatccactggcaaaatttttgcttcctgttcccacaacattatgttctgctggcctagaggtcttagttccaaagggaggaacgcggctaccaggagacacaacaatgattccattaaacttgaagttaagattgcctggacactttgggctcttattaccttaagtcaacagggtaagaagggagttacagtgttggctggggtgattgacccagactctctagatgaaatcagtctacaactccacaacagagataaggaagagtatgcatggaatacaggagatccattagggtgtctcttagtcttaccattgcctgtgattaaggtcgacgggaaactacaacagcccaacccaggcaggactacaaatggctcagacccctcaagaatgaagcagggaaaaaaccacaacctgctgaggtgcttgctgaaggcaaagggaatacagattgggtagaagaaggtagtcatcaataccagctacgaccatgtgaccagttccggctccagaaatggggactgtaattgtcatgagtatttcctctttcttttgctaaaaacatgtttgtgcatgtatacacttgtactaagaaaatatctttattgtatttccttttcctttattgtgtgacataagatttactgacttcatatcagcatttaagtattgctaatcttatgtaatagtatttgggttggggatcagtgcgtttctggtagtacaaaggatagttgtattatgttaggtgtaattatgatcttattgtatttgaagattatgtatgatctcaggaaatgtgtatgggttcaagttgacaagggatggacttgtggtggttaataatgagtgtcgacttgattggattgaaggatgcaatattgatcctgggtgcatctgtgagggtgttgtcaaaggagattaacatttgagtcagtgggctggagaaggcagatccacccttaatctggtgggcaccatctaatcagccatcaacaaatataaagcaggcagaaaaacatgaagcgagagactggcctcacctcccagcctacatctttctcccatgctggacgcttcctgccctcgaacatcggactccaagttcttcagttttgaggctcggacctagctcttcttgctcctcaagcttgcagacagcctactgtgggaccttgtaattgtgtaagttaatacttaataaactctctctctatatatatacacatacatatgcatacatatacatatacatgcatatatatacatatatacatatacatgcatatatatacatacatacatatatatacatatatacatatatatacatatatacacatatatacacacatatatatacatatatatatatgttcacgactgcaagtggtcagatgctggctgctataccctgcctggacccagatgccacagcaatgtcaccttaatgaaaactatatgggggaaaatgacaacatctaagtgacaacacttcacccaccaatagcaacgcccttctcacacccaccacccaacgactgatactcatgccaaatctttcttgaaattactattccccaccatcctttacagactgcacttaagaaggaaggagcccacagaaccgaatatcaatcacagaagctgcatagccagacattcagtgttcgatgtaccgaaaaatcctctttacacgtctttatgcttctggccactacagccgcaaagtccagccattagaagggacagccatctttcagagtcatgtcccttgatgaaatgtcaatgccaaagaaatatagacagatatgccttatgtattttgccatgtctcctccctcttgccatcacagtctcctctaaaagagtaagcaactaaaaaagaaaagctaaatgttcagtccctgtaaaacaccatttacaataacaaactcacactgatagaaaagggaagatactgtattaatagcacatcaggtcaaaaaattagaacataagaatgataaaaaccatggcaattaattcaacgccctatatatagtctatcctgtaaatataatttgatttgcacagagctcctcagctggctattagtacagcgatcagctcaggtcttctaggccagtccttgctttgcagcacgatgccttgtaagaacaattcagtggctacaaaaccttggaaatagtacttaactcctttgggtcatccaagcaaaactactctcgtgaagctcatttcattgggatattggggaaagaaatagcagagaagggatggaggcacataagaaacaatcattaagaagacccaggcaagaaacaaaacaattcttgagcattttaagtaaagaaaaaggcagcatgttacagtcactaattaacacatagccctttctgaggagagattctatcacaggctccaggccagatactaaagcaaaagaatgtgtgaaaccaaactcctacctcattaaagatctctggtctgagttggccctacatgttattatatgccattatcttcatcttcattacaatgctgagttgtgacaccttctatgttgacagagctcctaaggatacagaaggagagtcgcacatcttgctctgtatcttaggggactgtctgctatccaagtgtacttgcgggtgtctatttggaagattattgaagtaaatgccaaaatacaaacggtgcattgtttgggtgcagaaaaaaacatatagcaaaaaagtaaacctgtgggatgtgttcaaggcaccatacagcaaaggcaatccatttccttgtgctaccctcaaaatgttatacaataatttctggtaaaaactctaaattaaaacaatttaaaagcacagcacctctaatcctgtttaagcctgaaatgatttataaatacctacccaggaactactctgccaccaaaggaatgcagatggcctcagtgaggattaatccatctctggaaggttcttgaggactaacttatcctttcttattttctccagagtctagcaaggttccacctctataacagaaaccccatgaatatgggactgctgttaattcacgctgtgcttttagttcttttcaaagcttacagatattcatatttttccctcattttcttttctctataaaagtcccataagagaaagagacacatgcacaaatcttgcactacagatgaggaaacaggcaccaaaggttcatgatttaccaggggccacccaggagcaataggccagcaccccagggcccatcagcttagggctttcctagattaaatgctttacacacatttcaggtagaccaggggaggctggctcttgtggactatgtgtacctaaattgcttaagagtcataaatgtggtccaagattttcaaaaagtcataaccagcacatgaactaacagaccaaagactcagcctaggtggggtcaaactaaagctgcagaggaaacattcctcctttctggttctgtgtccctaatggatgagggctccagtgacttggagggaagagtgctggtgctccccagggcctctcaacccgggtgcgcagccatctggacagagtcaagctctgacaaacccaacagccgccagggggtgtagctctctactccccccaggaggagaaggtgggggttctgcagctgtgtgctgacttgagcttcttcctcccccctctccccttcaggctcccctctgacccaacaccccatgggcttggcctcgctaaggctgggaaagggctgcatttgtttctatctctgatcacatttggaatccctggcaaagtgaaaacaaaccttccattcttcagccgtgtttgttttgggcccatttggcaccacccttcccatttcaggcttattttttttccacttatcgtcatcatgaatttggtagaggtgagtcattggttttaaccctggctccagcttcctctcgtttgtacttttccagtctaatttcctttatttgcagcgccttgaaagtctccaatcgctagcctctgacatggttatgccgggtcctgagctcgggctgtctccagtcctgaggcgtgtgggctcctgcacgctgggccaggggtttctgagtggttgttgtgttcctggttctgaggctcctgcccacaagatccgaagactcaccagggcagctgctgaccttcaggtggaggcagggagcctctgcagaagccggtgccgctgcagagctgctccaacactgccgtggtgtcttataaagccacaaagcttgagttgacaattggggtagaaggaaaatcactgaaactcctctgtcttaaatgagcttgatggaaagcagtccctaataatacaatcctagtgctgaaaagatgtctctcaacttaaacatttgaagtaggattttaggctttcttctcaataatttccccacaactctttgggaaaaggtgactagttaacagagcagaaacggtgggcaggagactggaagtctttggagtcacacatttggattcacatcttatttgtcagttactttggtaatgaccttaggcatgccattagtctttctcagtagatatacctgaccacaaaagagagtcccaccacttaccttgtaggatgtgaagactaataagactaagtatgtaaagcacctggtctaaaggtagctgtatttgctgttatttggctattagacttcctgaatactgctgaattgcttaagtcatactggggacaatcttctaaacttctcattccccaaggaccgattaagttgagacataatcataaagtcaacaggacacatgacagatgctttcaaaatagattcaagtcccatggaaaaaaatgttcaattctgcctgttggacagttgtcatttatactctcttccgcctcccctctggagtccttataaatatggtggccaattaggaagttatcattactcacccacagtgaaagaataaactgttcatgaaccattttctccctttaacacagtgttcatacatttctgaaatgtgtaggcttcacttgcattgcagagactgggatggtgtgtgtgtctcagataagtgctgctcacagcgtggtggggaacaagcagcaccactaactctgggagctcatgagaaatagtctcaggcccaccccagccctgctgaggcagaatctgcattctgaccagattctcaggtgatctgcaagtgcattcaagtttgggaggctccttggtcacacagaggaggcagaggtgtgacggtgaaggtgccggccccggcccaggaggcggggttctgactgctcttcagcccctgccacttcagcttagctgagggacaacaggcgagtcatatcaccctccaagcttaccctcgttacatccaaaattgtgaagggcctgaggttttatgtcacttgtcagctaatacgtcagcctgccactgtgtgtgcatgtgtgtggaaaagtgtgtgtgtgtgtgagtatgagtgttcacaacagaaggtgcaagacctctgagtcagagagagcagaaagaacgacatcttagcactagtttgctaagtgccagtccccacagtgatgtgacatggtgagggccaagtgtcacttatgcatgtagtggaatcatcacagaagagaagccccagaattagggaacgctgaccttgtacagggctgctggtgaccttccctctccactgtcgagagggagagacagagacttagcttgatcctggaatgtaagcaactgttttagggaagtggaagggaaacttctgtaagctgtattgtcctaaaatgtctccttatacgaacattattaacttggctgtaaatgtctttgctcagaggacctggactgtgcagaaacatgacatgtccataggaactgtctctcaatgtgcccatgtgtcaggagaatgggtggctggcacacagcaggcaacagtacctggccactgccccgggggagcttgtagtctgagaaccacccacaatggaaccacagtgtcatgagaggggaagtcccaggtgcctgtgggaacgcacaggggtcagcacaccctgatgaaggcagggctgtcaggaaagggttcctggggctggcttccaagctgagacttgacgtttggattggctggttctgagtgccaggcaggaagccctgacagtcggccgtgagagggtggtggggatggggcctgctgccttgctcctgatgctcaagggcccgacttcattctgagggtttagatgggggggactggggagagggagaaatacatgttgattccctggttctggcttggacaactcaatatccaagttatgagagcctagtaacaagatggaaaggggagcagagtttgagggacgaaaatggtgtgctgtatgtaggcaatctgctatgtttctgggagtataaattgagatatccaatctatgcagtcatcccttggcatccatgggagagtggttccagcacccctgtggataccacaatcccacagatgctcacatccctgatataaaatagtgtagtatgtgcatataaccttcacacatcctcccatatactttaaatcatctccagttacttacaattcctgatacgatgtaaatgctatgtaaatagctgttatcctgtattgtttggggaacagtgacaagaaaaaaaagtctgtacctgttcagtacagatgcaatcatccatttttttcctgaatattttcagttcacagttgggtgactctgccgtgggttgaacccttggatgcagaacccacagatacagaaggctgactgtctatgattaacaggcaaagaaaagaacatgaaggcggttgtaacttacttttttttcctggatatcagaaagtgaaatgctatttttttgtatttatttactaatatttgtttacaaatatttattcttttgagaattatttgttcatcttcttttgaattcactgggaatttgatgtgtttatgactgatttatatgaacttcccattcattttcagtctgtattaggttttcagctatcactgctactttttagaaaccttaagtgtggagttacttaaaatcctgggggaaagatttagactgagcccaaaggataggccaaaaagacaaaaaagaagacctctgatggaccaagactatgttcttttgccctattttcagagcttcagggaaattaaatataaacggatgtatggacaagtcaattctgagtttaagaaattaaagcagtgctactaattgataattttactgatttgttaatgttcttgagaaaacttgaccttccagtaagtccaagtaaacagatacaatcaccaaactcctgggttcaaattaatcacacactaggaaaaacatgtcttgccttagatacaactttcgatcacgaccacagcactggacagggggctgaggggctaacccacgaagaaggtctggagagatacccctacgtggcacccttgtgtcaaagtgtgaatgaattggggggagagatgcggagaggaagaggcagggggagagggccagtcagccccatccccagaatcaatgacatcatttattctgcttttttcaaaatgaacattgatgctgttcccccaaccagtacagattcaccatatttccacctatcgaaattctatgtgctcttttaggttcaaagagtatcaactttctcatgttaattaaacagcatgttaattgacaacatccatgttgttaattgtcctagtttttttctcaacccacggaacttatttaatattgcagggtatcaacaacccttttcccacaaagagtgtaggtttcaaaaatgtcaaaacaattccctcatgcccactttccactgaagccaggtatagctgaaagttaaccttagctacagaggtcatgctctgctgttctgtaggtaggaatgttagataaatgcaatgaattcatgctcttataatcaaacaaactttataccccaccaccatctttgaaaataggcacccatatcagaacatgtgtatttctactccatcatcttagcttccctccccttcatttcctacctcccacgatgctcccccaaaaagtaaacagcaattacttctcttaatttagattggccaagattgccctaaatttcattatcactctgaaactgctacaaaggaatgctcaacagatgtcatttataatcttctttattcctgacttagataaattcaaagtgatctagttagaggttttgtcaaattcttggaataccaaagatgtcccctattttccagtgttctttcttcggttgtccctacctagaatgccagagcaactacagccaaccacattctgactagcacaccaaacactcttgatcgtgcctagtttgcaggatccttagcctcaggcttgcccatacatcctgaagccatgtccacagagatgctactccagttccccttaacagaaaattcatccttacggcgaccccaagttaacagtgaagcagaagtgctcagacatccaggaactgccagagcctgcctggcgagctccagcatgcacttgtgggcccacgaggaccctgcctgcacagctgtgtcctgggacagctaccctagcatctgtcttcatttcctctttccacatgcattctgcagaaggccttggctaccattaatggtggttacgaaaattcaatcaggctgtcctcacaggcggttttctcaggagataaagacccttcactgccccttgccttctgtgctttctttgcagcattgctaagtctacttgccacagctcatcttcagctgtccatgtgcttatcatctgttgttcccagtggcatggctgccctgtgagaagagggattttgttttgctcactaatgtgtccccactgtgtagagtacctggcacagacgaggcacttacagacatcaggggaataagcaaatgcccacgtgcagcgagtggatgctcagatgtgcgtgccagggaaaacagctaagggctgctgctgaaaaaattatgaggacacgaaaccctgtcctatacaaatctactacaagagtgggggactgagagccccggtgggggggaatctttctctactgagagccctggtcgagaagaatttttctctactgagaaccctggttggggcaatctttctgtactgagagaccgggtcggggggaatctttctctattgagagccctggtagggggaatctttctgtactgagagcccgggtcagggggaatctttctgtactgagagcccgggtcggggggaatctttctctattgagagccctggtaggggggaatctttctctactgagagccctggtgggggggaatctttctctattgagagccctagtgagggggaatctttctgtactgagagccctggtggggggaatctttctctactgagagccctggtagggggaatccttctctattgagagccctggtggggggaatccttctctattgagagccctggtgggggggaaatctttctctactgagagccctggtggggggaatctttctctactgagagccctagtgagggggaatctttctctactgagagccctagtgagggggaatctttctgtactgagagccatggtggggggaatctttctctattgagagccctggtgggggggaatctttctgtactgagagccctggtggagggaatctttctctattgagagccctagtgggggggaatctttctggactgagagccctggtggggggaatctttctctactgagagccctagtgagggggaatctttctctactgagagccctagtgagggggaatctttctgtactgagagccctggtggggggaatctttctctattgagagccctagtgggggggaatctttctgtactgagagccctggtggggggaatctttctctattgagagccctggtggggagaatctttctctactgagagccctgcgggtggaggaaagggaggaatctctccatggctttggctggtgccagttttacctcagaccctggacctggattctgatctcttgctaccagctgcattggctttggatcccgagccctgtgtgagggttcctgaacctcactgcccaggctccaggtcctaacatctggctcagcagtgctccctgcacttcattccttttctgtaaagacctgggccacctgctcatccccactactccaggagacctccctagcctggcttctgcccggccacactgcctgtggtgctggtctttgtgcctgacttcccaacctccatgccactgtaaaccacatatctaaggcaatcttagcaatgtctgacttagggataggcaggtcacctgattctggccaatgagtttgctagggggcttctggcgaagctttacttgctcctaaaaagagatgaaagagaagatgcctgtttcttcctctcaatgccacttgtctgggtgtgaagcatggatctactatggccaaccctctgccagcctgtggaggcagctgctctaggaggagggcagagaggtggccctggaaaagccccaggcacccacctctcctgtggtcaaccccatcctgagacttcttcaaggagtcaatgtgtccttgctgcctgggcctgcagcctggctgcatgagatgcctctctccccaaccctgaagagtcctgatgtccctgaggagttcagccatggacctccagaaagtcctgtcaccacagtgagcttccgctttctcagtgatgacaatgtgcaggctgaacctagccatggttcccaattttcatgcctaaggacttcctttttattgaggtaacattcatagaacataaaatccattttaaccaccttaaattatacaatttagtggcttttaatacattcactatgttatgcaacccaccaccaccatctaattccagaactttcatcatcctcaaaagcaatcgatacccattaagctgtcactcaccattcccctttttctcctcagcccctggcaatcagtcatctgctgcctgtgtctatgcatttgcttattctggatatttcatataaatggccttgttgaatatgtggcctggtgtctggtttcttttatgtagcacaatgtttttaaagttcctccatgactgtatcattaatcagcacttcattctttgtatgacttaccatgttttgtttctccactcattggctgatgagcatttgggctgtttcaattttttggctattgtgaataatgatgggatgaacattcatgtacaagtttctgcttgagcacttgttttcagttctcttgagtgtatacctaggaagggaattgccaggtcacatggaaatgctgtttagctttttgagggtccatcaaactgcttaccacagcagcaagggccttgttttttgttttaaaaatatttttattatggttaaaacacttatcacaaaacttaccatcttaaccattttaagtgtacagcttagtagtgttaagtatatttacattgttgagaaacagatctccagatctttgtcatcttgcaaatctgatactctgtacacattaaacactaatccacatttccctttcccccagtccctggtaagcaccattctaactttctatgagtctgactactttagatactgcatatacatagaatcatgcagtacttttcctttggtagctggtttctttcactaggcataatgacctccaggttcccccatgacgtggcatatgacaggatttcccctttttaaggttgaataatattcctgcgtgtgtgtgtgtgtgtgtgtgtgtgtgtgtgtgtgtgtgtgtgtgtgtgtgtataccctacattttgtttctccattcatctgttgatgggcacgtgagttgcttccacctcctggctactgtgaacagtgctgctatgaacacaggagtacagatatctcttggtgaccctgctgctttcaattcttttgggtatatgcccagaagaggacgagggctaatttttaacacaaaaaactttgtggattgctacccaatatatgtttcacttttggtatctagatccttctggatctttagcaaaatctgacatctcacctctcaaggcctccatttaggagcacctggattaagtgatcctcaggttgtgtccaactctaaatctgctgattctatgagaatcccttgggtagaacaccacccttgatactccagcccgtattaattccacagtaatgactacagtcctgccttaggggatatgcactataaaaaatcaaagtaaacacctgccgagagagaagggaaggcccaacagaacatgtgaggataaagaattttcttccccaacatggctactactgcattcaccttttttcaccaactggaaaataagaagtaatcaagttaattgactattttatctttagagaatcaaagtccaagataattattactgattcagcaagtgttttctgagtgctatgccttctgagacaattgaagtcaacagggcttatctagataaaaagtacttaaaaacttcaggcctagtcattttaatgtaataaactcaataagggctcttactttcatgtggttattattacatatttcattctataaaatccaagcactggagagttgatttaaattcagttcatatgtttatgtagtaagaaaacactcctgataaatagtgcaacctttcaagtcacaccataaaaacaaaggagcctccgttccaagaggatgactgcagtgcagacacacagagcagagcctggaagggagaactgatagccccatttcctttcttccctccttccatcagatcaaaacagtcctgccggtgtagataggagtgtggcaatcttagaaggaggctgggacctgtggagggagagagagcaggaaggggccattcggaagctcataaatcacacctggtttccacatccgttatgtagccagagttgtacaaatactgtctcaaagcctattaccagaagccactggccctagaggaaagcctggccgcccgcactttctttcttatccccaaatctaaggagttcagccaggatctcggacatatgggtacccatatgctgtgccgctctgtggcgaggctttgattcactgcctgccagcctcaagcctttctctggcatccacctccaggacaggaggaatcaggctagattcactgggaatcctgacagtgctattaccctgtgttcctagggcgactctgagcaaaactccttaaaatactcacagcgtcatttctactgatcatgctaaaatacacatatccacaggtgttgggagaaatgtttaatttctattatatacaacaacaaaagtggtattgggccatgatgaattaatccatgattaaggcagtcccatgtgcttaagaaggcaattatttagctgggaaaatgagctaaacatgaagatatattctatttacatttattttttatctaaagaaacaaaatgaattaagctttgccactatttactatgtggcccccaggcagactgtccctcaccggcctcctggtcctgagagctcccagggaagccgtggggccgccacccaaaggcctccatgcccttcatctgctttcagtgtcttgcaacatacccatgactccatctggttaacggggtaatgagttcaattctctagtatcatcctcaatatatcccaagtgcctcaaactgtgctcagatgatgaatttagagtgaatttaagctaacttttacaaaatggacaagtagcttaaaaaaaattcctgaaaaaataacctctggaggccgaagttaatctcaatacaagcacaagtgaacataagcaaagggaagcgctcctgcctgtcgtcattggtctccatgttacaaataccaacaacctagtcacatgtgacaagaagcagctctccccaacaaaacctgaaattgcctggaagcccattagaaatttagatttacatcctgaatcattaacgagaaatcccatctcaagggtatctggaccttgagatgagctaatgatagtaccaagtcactagaaatagcaagacatttaaaatactgctgatttcatctttatcaaatatcttaccattcattttgtatatgtttcataacttatatagtggtaatgcagtgcacatgtatacttttaaaatgaatactcatatgctggggatgcatgcagaaaacatttttcttaattgatggagtgtgtgatcaaatttggggccacaccactgtacacagcatgcccttggtcaggaaaatgggctgctgcagtgctcagcctgagcaacagtaaacactggcataggggaagagagaatcatttgccatgtaagcatcatagttaataaattatcgtgctgtcattgctgttggaatgccaacagagccaggtactgccagctgacgcctagtagcacaaggtgctgcttgcttgttgtgggttgaatttacgtttcccccagaaacagaggttgagatcctaggctccagtacttaagggcatgaccttatctacaaacagggttgttgcagatgtaattagttaagaagaggtcatactggagaagggtaggcccctaatgcaataggacaggtgtctttataaaaaggggaagtttggtcacagacaggcacacagggagaacgtcaggcaaaggcagcagagtgaggctgccaccagccaagcactatcagaagctgcgagacaggcctgcgacagaccttccccagcgcctgcagagggagtgtggtcctgccaacaccttgatctcaagcttctggcctccacaactgtgagacgaaacatttctgtttttaaaccacccagtttgtgcaactgtgttatgggagcactaggaaaactaatgtgctgcttcttggtggagaggcagccagcctgcctggaagttctgcccactctaacctgggtggagatgagaatggctttgtcctaatggcagatctcgaagctgccattaggacagcctgcagcctctggagaggctgccagacgccaaccctccctgggcagcctcgcttgcacagatgtcatcctgcatggggcttcacacgcagcggatgctgccagcagactcggctgccgtcagggggtttgagggcttgtgcttgttctgtcaactttctgccgcccaagttgccacaggcaaaacgcttccttttaccactcccttgctggcacataaacggtgacacttcagcaatgccccattttgcctacaaacttggtctctgagtctcagtctgacaaacctgacaggaagaactgcccaacagcaacgggaatcttcctgattctccttcccagggcagatgggctatttgttactattttatgctgccatgaaatcaggcctgctttttattctgagggtcttgctgtaccttccttacagcttctccctggaagaggcctctcagtccataagcagtgacaaccagttaccccctcaaacagacactacatgtcactcagtgcctgggccatgttgcggctctgcctttggccagtgcagggctctgtggcccgtggcactccagcacctgggtcagctgctgctggcaagtggtgggccctgtctgccagcacagggcactcacaatattggagctgagccaggtacggtggctcacgcctgtaatcccaacactttgggaggctgaggcaggcgatcacctgaggtcaggagtttgagagcagcctggccaacatagtgatatcctgtctctactaaaaatacaataattagctgggcatggtggcatgtagcctgtaatcccagctactcgggaggctgaggcaggagaatcacttgaacctgggaggtagagcttgcagtgagctgagatcacgccactgcactccagcctgggcgacagagcaagactctgtctcaaaaaaaaaacaaaaacaaaaacaaaacaacaacaacaacaaaaaaaactggagctgagagctggccggtgctcagcatccctggtctactgaaatctccacacacatggtagagaacagggacacgcccctcttaaaaggcagctggcaactagcctggatataaaaggtgacattagaacttaagggtaatgttgaaattggttcaccaaacggcttaaagttcaaacatgcagatcatggctaaagataaaaattcccaggcatacatgcctgagatttaagctggcacattgctgggccatcttttaactgaagttttaaattttctatttattatcttaacaatgaacttgactgagagaaccattaaaaattgctatagatcaccatttggcatctgctacgggttgacttgtgtcctccaaaaaaggcatgctgaaatcctaactcccagtacttcagaatgtgagcttatttggaagtgggatctttattaatccagttaaaatgaagtcatcaggatgggtcctaatccaatatgaccagtgtccttatgaaaaggggaaatttggacacaaagacacacaaagaggaaagatgatgtagagacacagggagaaaccatgtaaaggcacaggactggagtgatgcatctacaagccaggggatgccagagattgcagaaaccaccagaagctaggggagcagcatggaacacatgcttcccacagctctcagaagcaaccaacctgccaacaccttgctttcagcattctggcctccagaactgagatgacaaatgtgttatttaaagccacccaggttgtggcattttgttaaggcagccctgggaaacaaatacagtatatctgcagtagttactgtttcaggcaagcatcatcagtgaatgctgaaagtagcaggcaaaagtttgatgagaaacacaatactcatagagttgcaaagtattcccccatgagatatgtatgaattacaaagggtaaaatagtaaattgatagtggagaaacttggcagatgccatcttaactgaacaatcaaagctggcatcaccggccatgagatggggagtgtcgtgtacctcctgatccaatgcatcaagaaggacaagacctcgcttctgtgcagcccctgccctgaaagcaggacctgaatccaatcatgaaggcacatcagaaaaattgaactgaggaaaatcctacaaaataaatgacctatactcttcaaacatgtcaaggtcatgaaagattttaaaaagctggataactgttctagattaaaggcgactaaagatatatcactaaatgaaggtataatcctggactgaaatttgtggcagtagtgggaaaatgggccaagtctgaagagtctgtagattagataacactactgtttcaatgttagtttcctgattttgataattatacagtacttgcttttagtaaacacacactaaagcattccagagtaaaagagctcttcagaagaaagttcgtataaacagacagatgtagatttagatatatgtgagcgttaagaaatgggaggagcagggctgggtgcagtggctcatgcctgtaatcccagcactttgggaggctgaggagggtggatcacaaggtcaggagatcgagaccatcctggctaacacgctgaaactctgtcactactaaaaatacaaaaaattagccgaacgtggtggcatgtgcctgtagtcccagctgctggggaggctgaggcaggagaatggcgtgaacctgggaggtggagcttgcagagagccgagatcgcactactgcattccagcctgggtgacagagcaagactctgaatcaaaaaaaaaaaaaaaaaaaaaaaaagaaagaaagaaatgggaggagcagcaagtgtggtgaaattttaccatatgaggaatatggtgaggggtagatgggatttttttagtactttttttttttggcaatttttctgtatgtctgaaattatttcaaaacaaaaagttttaaaaaatcaccacagatgtaataacagctatcacttaatacgtgactgagatggttgaggtgtttttatatgttgtctaattgaccagtgaattataatcacatgaggcaaatattatgattcccactggcactctaggcctcacccaggaccaagaagaggtccatcttggttggaaagggatgagggaactgaaaggctctcgcccacaaggctcagcacacacacagagcctgctgaagtccaatggcagggcaggaaaatagacacaccttccaggcattcatatcctaagccactacaagtgggaaggttataatcctaccttcaattaatttgatatttgtgaggtcttgaatctaacttaagcagcaatacagcccaggcccggttcaactataaatactaaattaactcacacacacacacacacacacacacacacacacgaatgggtttgaacagaaaaggcatgctgttttctggactgatgtaaatattatttacttcagcttctagtgttatttctgtctctgtcattcttttacacaccaggttttactttacttaaaaattaaaagaccctcgaagaagtgatgtgacccactgtaaagaaacaaacagttaacagaatgagggaccaagcctggatgttggactcatcagatgaagatttaaaataactgtgataaatatctgtgaaaagacaggaaatttcagcagagaaatggaagctatacatttttaaaagccaaatggaagtggaaatgaaaaacaggatatcaaagatgaattctttcactggacttattgccacactgggcacaagagaaaggagtcaggttcaaaagaaaccatctacactgaaataggagaggaaaaaagagtcggcggcagagaggagaaaaacagagcatccgaggcctgtgaacatatcaaatgttcactatgggtacaactagagtctcaaaaaaagaagagaaaaatgaagcaaggatatttttgaaaagacaatggccaacaatttttccaagctgatgacaccaaaccatagataaaaaatgctcagtgaatcccaagtaagatacatacaaagacaaccaaacttggtgcatcacaaacacactgttgaaaaacagaaataaagagaaaatcttgaaagtaaccataggtaaacagaaacattacatacagagaaaaatgacaagaattatggctgacttctcgctgtacacaatggaagccagaaaaaaatggaatgccgtgtttaacacattgaaagaaaaaatttttaactaggaattcaatatatagtgaaaacatctttcaaaagtaaaagcaaaacaaagacattttcagaaagacaaaacctggaagaattcatctccagcagacatttactatcacaaatattttcagaaagagaataaaacagacagaaacccagtgggaagaaataaaggacaccagacagaatgaacattagatgtgcataatgaatctttaaaagatatttcatatctatctttctttaaacatctttaaaaggctactattaaaaacaataacaatgtaagtggaagttgtagccagtggtgtgttggagctgacttacactggcatgtagagctgactgttcacatgtcttcacaagtctatgtttagtgatgtcatgttgttagtttaaaattggctgtagctgggtgtggtggttcacgcctgtaatcccagcactatgggaggctgaggtaggaggattgcttgagctcaagagtttgagaccagcctgggcaatgtggtgagacctggtctctacaaaaaaaatttaaaaatttgctgagcgtggtggtgtacacctctagtcctagctacttgcgaggcagaggtgggaggactgcttgagcccaggaggctgaggctgcagtaagccaggattatgctactgcaatccagcctgggtggcagagtgagaccctgtctcaaaaaaaagcaggtgcggtggggggctgtggtaggagtattcacaccataaaattagcaaatgctacaaatcgggcttttaaaattttttcttggagggccaggagataagtaatcaccagcacattattttttatagtattggtagaagtaaagtatatgacaaaacacaaagtgggtagagtggtaattagaagtatactgttgtaagtttcttaagttgtttatgaagtagtagactagtttctgaaggcagactaagttaaaatgagggttggcaaagcttttctataaagggcgagataataagttcagtccatcattactatttatttattccatttttgtaaacgtgcctacttgctaaaatttatttgtaaccccaaaatcaaacacacgtagcaccttcgtggtcattcacagacacaggcagagcagcgaaggctttttgtagtattttttgtgacaatcaacctgcattttcccagctgaggctgaaggtggtgctctgccttcttcccgttttcatactgtacacaatgtgcttctcatggcttccacggtaaagacactcttttcattttgttttgtaattaatagatatattggggaagatactttgagactacgcaaatatcctgttgactacgtaaatatcgtgtttttcctcaaacttttacccattaattctgacatccatcagtggatcttgtctataacaattactgtgctgtttgcctcctggtgatattctagttacctcctttcttatacattaagtaactggagttcttctacaaaaaagagctatccgttctcctggcttgttaattcaattatttatgtcagtatggactcatggatatttattttaccgtatgggttaaaatctaacactatcggccgggtgcggtggctcatgcctgtaatcccagcactttggcaggctaagacgggccaatcacaaggtcaggagttcaagaccagcctagccaacatggtgaaaccccgtctctactaaaaaaattagccagacgtggtggcaggtgcctgtaatcccagctactcgggaggctgaggcaggagaatcacttgaaaccggaagacagaggttgcagtgagctgagatcataccactgcactccagcatgggcaacaagagtgaaactccatctcaaaaacaaaaacaaaaaaatctaatactatcactttgttgcaaattattccagctaaggccataaggagattcttcaggtgggcttctataacattctgccctgccccaaacctttctggagaacttccttatgttctggcactacagtatattccaggctcatctagtatttttcctgtcctggcctggaatcaactacttctccaaggaaccgtggttcctctgactggggaatggtgtttagacaccacagtctgggccctagggatgcttatggctgcatgggcgtcagttctttaggccctctcagtgaacaaagctaggaaatacaggtatgacactaaccctctcatccatattcatttctgtatatctgtataggtatgtttgtatctaccatccatccatccatccatccatccatctatccattcagaaccatatgttcatacagatacttctagttcccatccaacagcaccaagttcatttcagtcttctccctttcctatttgtaacctctttctctgacagtgaggaactcggctctttgtttgttgaatcctagtattcacataaggcaatttcagaattgctaaaccatgccccttaagaagcctgtttactaactgaagtacaccatttatgcatagttttttattgtctttagccttatagtatccacttaaaaatgttgttttccaaagttaattaggtaactccctactcccttaaatatggttatatcaagcaattgcatttcccactcccttcaatccgtcagtgcttgtacgccattctgggtccctcccacctcttggttgatgtgaattgttggcttacttgtcaggtgtgtgaaacagtgccatggttctaggtcagaaccatgcaaaaagtcaagctcagggaagaattgttccttattccccatttctgtttcttccttctttccaccccttttccatccaccacttgtcagtgaccaaacccgttcttttctggtttacccctcctgttatccattcctttttaatatcttgtaccaagcccagatcatggcagaatgtcagcaaatgtttgacattaaactgttttctctagtgaaccctgactcctaaagtccattctatgtctgcagtctctcctttacataatgaaactggctactttatcttatgacactcgacaaaaggcttggaaaccaccagtttccttaattgggtcggctcgagatggaatcaagcagccacgcaggaaagtattagctaataataatgaagactattactcttcctggacatgaagaaccaccagtaactagaactcaggttgacggaaattctttggcagcattttcacattttggctatattttttttaacacagcatctcaaaacaacttggtagcataagaaattacgtttaagtctgtggaaagctacaagattaaagggaataagagttgcataaacaattgcaagaaaaataactagtaaaagttgcagggctttttttttcctgtcaacacagtaacatctttaatcttccacttgtcccttttctctgtaatcagtacttgattttccaattaatggggaaggaagccaccagagatgagtcagtaaatttaaaactagtcttgaatgtctggcaaggaaaagaaagttttgcaaatgtacatctatagctaagaaggaaactggcatttggtgttaggtactcattttcatatctgaacaacactgggatcaaaattaaagaatataaaactttaggatcagggtaatgtggataggaaagtcacatgctataagacatttccaagaggataattaagtgttttatacattctgcaagtaagtaggcttttccatacctgaagtaaaaccagcctagtcccctgaaaccttattgtaaagtgataattagaccacctactgacggtgaggctgcaaaagggtaggattatgggtttgaggagcgcagacaaggttatgggcaaccccagaatcagtaagtttcatttacagagagatcaggattgcaatctatgtggatccagggacttacgtgacatatcaggggcaagggcttccaaaccaagacagactcaaggctgaatcctggccaggccaatgaccgactacatatcattgggttggaaacctccctaagctttgctttcttcgtctctataatggacacagtaataccaacttataggtgcggtgagcactaaattcaacgtgaagcacttagcaggtgcccagcacaaaacaagagcccaatggctaagcaaagcctcgtggagcagcgtaaggaatccagaagctgccaccagcactggaatgctggcactgccacttacccaccgtgtgccctcggaaaagtcacttcactctcagagctcttgaagagggagtagtaattcagaatgggagtaatagccaataataaacagctctgagatagggatgataacaaactgagcagtagcacagatcaaatgaattaatatgaacagagcagttagaacagagccgagctcattgcactctgtaagaatgagtgatgatgatgattgattatgattattcaatcagtccaccagagaaatggggagtgggagtgcatggtggtaaaagtaaactattacacagagtaccaggcctcgtggagtgtgttagaaaaagctgttttggcaacttacatcaatagctaaagagtgtacacaggcttaccccgttctgtaaatgctgtgtcgagttgtttaacccacagcagtaaacagccaagccaaagtcaagaggacaagtgctaacacactcatcaggaatgtatcctagcaatttggctgcagggaacaacaacaacaaaagccttgctcatgtgctttgcaaaccataccctgcagtcggcctgcttcaaaatatctggttctctagagatagagaacaaatctttaaggtaaataagatgctacaatctacagcgctggggtgctcgatctttcctcttcaactgttcatcctctggcatatttatttaaattgatcatcttctagaaaagctgcatgtcaactcatgaaaaaaatcaacagaaagaaaactagtgggctgttctgtccttatttctaaacttgctaataaattactatctctcattgtattgacactgtgttaggtagggaactagctatctgtaccttattccacttaaactcaccaagaaaagcagtgtttcattaactttccaggaactttttttccaggcaaggcgatatctcttgccctctttcttccttggggaaacagatggttatgaagaagggcaatgacaccccaggtttcctagagggaaattactacaggcttacacactcttagcctcgattcccaactcaagaatgctcagaaaatggaaggcttcctcataacttgtacggaggcaaaacttaacctgaagtgacactagtccctaaatttaaaaaaattatctaattcggtttgaacatcacatatagattacaatatactgcctgagaccccactgggggtactatgtggtatatgcaaggttttattctcctagggggtactatgtggtatatgcaaggttttattctcctaaaagcagtaatatcctcctagactcccaaatttctccattctaaaatacgtcgggccgcaagtcctacagatatacaattgtgaacttacaggagagttgctgatgctgttacgttccaaacatagctttgtgaatacagtaagtgagaaaaataattctagcgttttttttttgtttttttttttttgagacaagagttttgttctgttgcccaggctggagtgcagtggcatgatcttggctcaatgcaacctccgcctcctgagttcagggggttctcctgcctcagcctcctgagtagctgggattacaggcacatgccaccacacctgactgatttttgtgtttttagtagagacggggtttccccatgttggccaggctggtctcgcacccctgacctcaagtgatccacccacctcggcctcccaaagtgctgggattactggcgtgagacaccgtgcccggacaattctagcattttctttaaactgccttcttttaaaccagaactgggactgaatctttacactgctaatctcatgatttaaaatggacaataatcactaataatcactcagaaatgtcacccaaaatgctgttcttccctcacgtggccgctccgtaactcatactgtatcaggttttatagacaatactcaatggggaaggccacttagaagcagacaggcagggttaccaagaacatgcaccacttcctcatgtgggtgcctactcttggcaactatccatttggaagcctagcccgctgagcactccatgagaactgggttgaacttcctgctacgttacctagcacggtgcatgatatgggcaagctgatatcctctttggggttctgtttccttgtacataaactggggagaataccacctactattcaggactgctggaatgaaatgaaataaaagcatgggcctaatccacaggaatcaaggttagcttctttccacagcctctttccccttccacaccctctcctcttctgactgagacatcatctggagacaggctgtataagtagagagcttagtgctttcttctacgtggacgagctcccgcagaggtgtgttagtggtgcctgtttgcgtattgcaaagtcgagagaaatggattcctttcaaggtccctgaacccaactggaaatctgaacctttaaggaaaataggtgttgagcaggggaggaggggtctgcaaggagacccctgtgcaggccccaggagggttggcagcagaggtatcatataaggacacccagtcactcataagggcatggccttgtaattctagatctggctgatgatccgagggaggaaatgcttcaaccattctgaaatcagaagttcttgccccagctacacagacagccaggtccacccctgaggttcaactagtgcggcaattctcaagggtctccatgtgatttcagtatggaagcctaagttgcaaactactgcccagaaattgttagtatttgtttctctggaatgacaacagaaacctggagtacaaaagactcacaggtgcaagaatttgcctacttcgtccactctggtggtccagccttgggaagagggtggctggcagctgtgtccaccatcagaaaaccaatgagccacaggaagctgctcctgcttggcttggcttgccctggcttccaggaagggaggcacactggctaaacccaggcacctgggcaggtggaggtaggtctctaactgtgcagacagacggggcaccagcccctgggtgtggggtggggaacagggtgggcgcgtggcaactgctcaggaaagaggacctctaggggctctattttctcccctgactgaaaacaaagccccctcctccctgattaggaagggaaaaatacacagaacagggccccacatagcccaggagttatcagaatcatagaacagagaacaaatgttaatgcttaaccgaatagggtttttggaaaacatgctcaagagtcgctagcatcatcccacctggggctttcccattcctggtcatccttgtctttctcttctttggtgtctcctgtatgtgggtgtttctgcacaattcgcattccaccagctttcactgaaatgaaaacagagagtgtgggattaatgtggaaatggggctgcctgtggatcagggggaccagctggaaaggttctggttgctcagtggccacaagtcagtctggagaatctggcaatgaaaatgattaactagggaaggtcagggttgtcggggtaaattcaaaatgatacagcactcaacataatctcttactacagatccactcagaaactttccaaggctcttgtttttctatctggtcacctttcaagtattttgtcagagcagcagtgtaacgagggcacaaactacacaaagagagtggctgctgctttcagttctccacagtctcaacacaagagctcacctcaaccctcccctgtgaaatttactttctcaaatatcgaagatgtttttgatggggtgatatggtgatgggtgacatgggacagctactgtgccttcacagagcccaggcaagtggcaacaaaacttctactgcagctttgcccaaactgtgctgtgaaaccctaccgctggcagatgttaacttagttttaaaaaacagctttatagatatgtaattcatgtagaatacaattcattcatttaaactgtataattcgatggttttgagtgcattcagaattgtacaaccattgccataatcaattttaggagattttcatcaccccaaacagaaaccccacagccatgaacagttaccctccattccacccctcccagctcctggaagccagtcacctggacttgcttatttcggacatgtgatataagtggaattataaactatgtggcctttggtgactggctccttgcacttagcgtgttttcaaggttcatccatgttacagcacgtgtaagtatctcattcctcttcttgtcaaatattctattgcatggatgtatcacattgtatctctccactcatcaattagacatttgcgttgtttctacttttttggctattatgaacaatgcagctgtgaagaacttacacgtaagtttttgtatggacatatgttttcatttccttgagtatataccgagaaatggaactgccaggccacatggtgcctctgaatttatccttctgaaaaccaccaagctgtcttccaaagcctccacactatttcacattcccaccagtgtgtgggttccaattctccacatgttcccgacacttactattgtgtgtctttttaattatagccatcctagtgggtgtgaagtggtctcttattgtggtttgatgtgcaattcctttatggctaatatgttaatactgtgttgtaaggggtcgggtaatctagcatctattaagagtgggaaatgccaggttgaacaaaattaaataggtttccccaagagagaccttcttggcccttagtgtgctacctgcatgaggaagacttacaggaggcatacagcttgccagctctccccagcctatctgaccacacaactttttttttttttttttttttggctataataccagttatcctccatcagggctacagtgttccatgaacagaatttggaaatgctggctggccctaaatccaaaaagccagcctcgcatggtagccaccagcatgtgtttggggtcggcacgttcctccacgccctcagctatgtggtctcagactagtgtctcagattctcaaagattccctgcttcatctgcagaaaggagataaacctcctcagactattaagaagagagaggcgttcgggagagtggggtgctggctagaaagcagggtcattttccttgtagtcattggccccccaggctctggatgtgggccttactgagctttacccttcaagtctctgagtctctgccacaagacggctaacatcacgatacagtcaacttgccacaccatgtcctctggcattttaaactgagtggaccctgccgagtcacgaaaacccaggccaactttctttatgctgctgatgaacgggaaggagaatgggagaggcagcctggggcttacatgcttcaggtgtactggtcttcaatttccctgggagacttggccagcccgactggagggagatggtgacgtttgctcccaggaccagcactgccccagcagctggctgttagaaaagggcaaaagagagcaaggaaaatgacgactatttcctctggcttgggtttagaactaaaatctccctgctgcccgcacctcttctcaacggagaggacattctacttggggcagaaggaaacagaatcctgttcagtaatcctctcaaaaatctgctctatatcccatcaattgatttttaatcactctatttttcattcctacagcttttgtctcaaattcaccaggtatttgatggggtcttattcttttcttgtgcgttcaattcctttatatatttaatcattttagttgtatatccaattatttgattttctgaagtcctctggagtctaatcctgctgtctgtttttgcctgtggattcttgctcttgtcctgggagacttggaggaggaatctgtcttcactgggctttaccagtaaggatctcatggggcctgtgatgcagacagcaaccctctggggagatgctacacgtgtttttgtcaggccaggagtataggtgtctgaaaatccttttcaaggcagatttctcagaagacaaattgccaaacagtacaaatacgaactgaactcatgtaaaagcaagcctttgtttacaaattctcaaggagacctctgtccccatgtggagcccagcctgacacagtccggcttcctggccctcctagggccactgggcaggtttccctcttccacctttccccaggggtgtggcctctgagcatccaaccttggctactccctgcctcctgtgggcccacctctcatgctaaaggtctgaatttcagttccttcttcgttttgggtttccaggaattcctttcacttcaaggtcaaattcttttaaaaaagcaaaaagccaaagacaaaacagaaaagacctaccatttgcaggcagctttttaatctaagattaaaaagatttcccagcctacgtagttggcctcccaatcagaaatggagactgaaaatacaattatctacctacaccttagggtcattttccactctcttgaaacacaggatctcagagttatgaatgtttcgggctcaaggaagagcttagaagaactgtcccactaaatattttttaaaaattcatttccctccctgctctatcccacctctttcccatgctcatcagaaattgatgaaagatgctattacgggctgaatagtgtccccccaaaattcataggttgaagtcctaactgacatacccttaaattgtaattgtatttggagagagggtcttaaaagacaattaagttaaaatgaggaattgaggtagggctctaatataatagaaatggtgtctctataagagaaagagacaccgggtcgtgcacacacaaagaaatggcctgcaaggaaacagcaagaaagtgccatctgcaagcccaggagagaggtctcaggagaaagcagagctgccaacaccttgatcttggacttcagcctcccaagctgggagaaataaatgtctatggtttaagccacccagtctgtggtattttgttaaggcaggccaaaccaacaatacagatgcccatttaaaaatgatctctgaatctttccaacttggcacacataaaacttttaaactgtaactcacagatgtgttcataaagtaaaaataaaaagagctgtgcaactaactataaagaaaactaatgatgaatgttaaggtgacatttgaaatgatcaagtcttctgaagctcctgcagggcagcctgtccgctcctctgctgaaataagcacacagtgtcaaggctcagtcacccagcattagcacttgcatttaatttagtttctaaaaacaattaacttcattaatccctctcagttatgtttggtgattaatgtagcaataaaaagtggcaataataacaataataactcaaagctgagacagattcattttaacttacaatactgccaaaaaatatgacagcacatatttattgtgattgttgtatcactgtctctagaactcttcatttgtaaaactacaaaagaagaattacttttgcagaaatctttgcagaattatttgcaaatcagtatttttaggagaaacagaaaaaccttagatttttgtcgtggtggttgttattcaaatgagagcttcaaatgtaaaaaataagcttcctcttagcagaagtgctgtgcagaggataagaacacagatgctggagccagaaccttgggatcaaatcccagttctgcctgtgtgtgtgtgtgtgtgcatgtgcctgtgcataagtgtgtgcacatgtgtgcatacgtatgtgcttgtgtgtgtggctgtgtgtgggcaagttgctgaagctctctgtgcctcagggtctgccacctatgaagaaagagtgaaaatgttcccctctcccagggccagctgaggattacatgagttaggacacatgaaatgcctccaacaggacctggcacacaggatgtgctcaactgttagctagtcttattaaatgggtttttaagttagcatttagtactcaagagaggcctctggagtcctcaaatcgttggtgcttttccagctcttcaccctctcttcacagcagttccttaaagagcgctgccctacgggttgctggggaatgaaggccatgccctgtaaagcacctgcccatcgtggtgctgaccaccaccaggacctccgtcattacatcaccacctgaggaagctttgggagaatcacagatccaacttctgctcctcatcaccactctgtggcaggcaccgctctaaccacttggagtccacgcatctttcactgcacagcagccccacggagtagatcctgaggcagggagaaggggaagccagcggccccaaatcgcacagctggcaagcggcaaactgggttccacccttaatcgtaggtaagcctttccttgatcagattccttccaggaagcagagcaccatggcttctgagagtaactcaaaggaacggcctacagacagggccaggttattacactacctagataagggaaggtgagtttgaaatgaaaagctctccacagagcagctgcctgcccaagtgggaaggggagtggaggaagctttacctacggtcacatctgggaggtaagcaaacaccaaggaggcaaatgactatgtgggaccctgggccaagcatccgtcctcaggtgtcaggatgcctggctgtaagatgcagtcactggtggcttgctatctgctagtgccaaatagcaaactagaaaatgctactgcgggaagaagaaaggggaaatactggaagagttccatgaaccagggagcaatttccagcagggagctaggaagggctgttaactcacacaaatgtcccaaaagcatccactgcaggtactggagtatgactcacaagtatatgctacctttgttcttgcctgagaagagctatggaaatgttattcaaagggaagctcttctacctaaaagaagtgacgaaaggttctgaggactgttccagtggaaggaacaaaacaaaacagaaaacaaccagtgctgcaggttatgattaaaccaaaggatctcaggtagagcaatgtagtggcaggtaagcaaaggggctggtgagattaggtgggtagaacttcccaatgcgaacagggcaagggactatggcctatcttagttaagaaaaatgactccaccaggagagaggagaatcactggcaagtggagactcacatctatggaagcccatgcacctgaaggtgggaaccctaaaaagtggagaggataaaggggtgagaggcggtaagaacgtatgcagagagtgggtactgacagtctggcccaataacagacataagttatagaagaccccaatgagaaccttgcccccagaccaagtggagcccttacaggagctttcaggtgtgcatagataaggtagaagtaatggtttgtgctaaaaaatgagctggagccccagatactttcctgaatttgcactctcgttggcttcatactgctattctgtgctcagaatcatagactgtgaaggtgagaaggctcttaaattacacggagcaaccctgttaaagaatgaagttcagagacatagtgggacccccctgggccaaacactccatcttccacagcagtgtgtgttccatccttgacatagtttctgacccaaaggacaaaatgagtactgactgggccaggatgggcaccttgccggacatctgactgggcccctttcaagctgggaggtacatggagcagctacatgtatatccttgagtgcagggaggctgattcaaaaagtttaggggaaagtaggatcggctgcctggaagtgctttggaaaagctgtcattgggaattggttgaggctaggactagtcaggtgtttgccagtctcactcccagcttccccgtagttggattgggggcatcaaactgggtcctgcccaatagtatggggaaaagtgactttggtgggcagcatcatgtcatcacgtccccccactctggaacctgtgagtgtgctgggctacacggccaggggaaatgagggttgtagatggaattaaggttgctcatcagctgactgtaagctgaggaagaagaagggaaactgctattctgtgcttagaatcatagactgaaggtgaggagattattctggattacccaggtgggcccatgtaatctcaagggtctctgaatgtgaaagagggaggcggaagagtcagggctctgagtgtgtgatgtgaggatgtgactggtcattgctgcctttgaagaagctttccttggcttgtggaggaaggcgccacgagccaaggaaagtgggcagcctctagaagctggaaaaggcaagaaaatgggattctccccgatcctccagaaggaaccagttgccctgtggatactttgattttagcccagtgagacccatcttggacttctcacctctagaactgtaacataataaaactgtgttgtttagaaccactaagtttattgtgatttggtacagcagccataggaaactgatgtgatgatgcataccacttgtgggccacaccatacggaccccagcacggcgacctacacttgtcccctcagcagcagccacacaatgaaaagctagtgttatacagcaaggggtgtctgggcctctgaattgctctttgttaagaagaccccacccaggagagaaataaacctggattagtttggccactgagaatttaggttgtttgttacaacaggaagtaccattctctatacctaatatagtactttatacaaaagtgaacattctctatagaaacaaaaaaaacttctgaagctgggaagggaaaagcagtcacaaaaccaagtaagaatgcacagggcactggccgaaatgaaaaggacactcacaaagacgttagaagtcacagataaccaaaaatggctagggaaggctgggtgcggtggctcatgcctggagtcccaacactttgggaggccaaggtgggcaggtcgcttgagcccaggagtttgagacctgactggacaacatagtaaaaccttgtgtctacacaaaatacacaaattagctggttgtggtggtgcacacctgtagtcccagctactcagcacactgaggcgagaagatctcttgagcccaggaggccaaggttgcagtgagccaagatcacgccactgcactcaagcctgagagagaccctgtctagacaagaacaacaaaaaaaggctagggaagaggtgaaatgccatgggccaccttgacagaaggcttctgaaaaaagatagtaactaaagggtcttgttttccttggcatgttgggaacaagggcagacctcttacctggaccattcaatttctggtcctgactggttgacactgggactatgcttagcaaatctgtgaccacagggttaatagaagacaaattagtcttctgtttctagcaatggataatctgaaagtctttctgcagggagataattcagggagaattacactagacttttgaaaggcatccttaactcatgtctgacgtatcaattagtgtaagagagaactaagttactctgaagttactaaaaaaagtaacatggcttgaaataaatataatcgtgcttatatttccatttaattcactttgagaggggatgtagagtctgcttttcaaagaaaaccacatgtaagattagtaacattcaaagctatcatgtagcagatttatgagaactctactgacacatggttttggctccactgggaaatggaggggaacagggccagcaaaatgtatttaacaaagagattttacacatctcactgccacagactcacaaagactggcagaaatgagtaatagcgaggcttataattaggtcctcttttctgctgtggaatgctatgactgctgttagatgaaacagaaagaatctcgctaattctaactctgctaatctgcatttgcaataactcatcaaacaagcactcaccccatttctctgcaaatattttgtagtcaagagcagtggtaaggtctcaaatcattaaggctggattacttctacagaggactgcagacgacagcacatttgccaggacatgatgcagtgccatccatcacttgtaaataacaatacctgtatttgcacagcacctttctctaacactcttcagaagcctttacaaactgcctcattcgtctcccaccttgggaggaggcacctggccagtgatggagtcgtctgtcgggctgctgaagttccaaaaggcaacagcctttccggccgctcccactaggtcactagctcaggggagttggcaacagacactccaaacaattgggtcaggttttttttttttagacgaaatattcgctcttcttgcccaggctggagtccagtggtgtgatcctggctcaccacaacctctgcctcccaggttcaagcgattttcctgcctcagcctacagagtagctgagattacaggcacccaccagcacacccgactaattttgtatttttggtagagacggggtttcaccatgttggccaggctagtcttgaactcctgagctcaggtgctctccccacctgggtctcccaaagtgctgggattataggcgtgagccacgacacccggctctgggtcaggtttttaaacggcactgtcctcggtatctcaatgttaagatgactggtgatttcatgagttaaacgtgccaagcgcttagaagtgtgtcagcacattgtgacactcaacaaacttcattagtgtttccaccagtctgctgcctgaaccggccaagaggaccacctgcatccctgcgcacagtacagagagctcagagttgaggaaggtgtgggcccggtttgctatgggggcagtgaggggtgagaagaggccctggggaaactctggagtgcttattgagtattttgtgccaccccgggaataaagagatcaagaagacccagccctggaagcaagaagacaggcagagaggcgaaggttagtgcacgaaggaaaacaaggggattgcggggaatgtacaggagatatgggccagacagcaacaaagagaagacacaaaagaacattaagatagtcactgtaagagaattttattatttctgattgagcattgaggcacaagtctgttatccaatttaagcacttaatgaaagcattctcaacatttttaaggcagtgattttgatttatgaactgtgctcttggctatccttgatgattatcctttagtgtagtgggccgccttttttttttttttttaaaaactatctacccttcagagctgcctactctctggcaatgccagactaaacaagaacaccagagcttcctgccagaaaaggttcacacatggtcctctgtaacatctaggaaagcgcatttgaggggtgctgttggcatctgaggggtgctgttggcatttgaggggtgctgttggcatttgaggggtgctgttggcatttgagggatgctgctggcatttgaggggtgctgctattgggcccctcctctaactatggtcttggagacagatgacagatggtgacagccacccgcaagagctcaccccgtaagtctaaaggggttgccctgaagttactagaggagtttacctgggggatgaacagtgctggtaccctgatgctgaagcgggacgtgagactcactgcagcaaacacagccccaccctgtgacttgccccgaggcccaaacctcgaatttcataaaggagaaaaactgagccccagtgaagcgtgaagtgatgtcttcaaacttagaacccaagctcactgctacactagcacaaataagctgcctcttccctcctcaggggtaaataaactacttactctgtaattcacaaagcctagctgtttactctgcaattcaaagaaaaccagagtccagcaaggaatttctcccagggagtgagtatgtacagtttatacctctgaccttaaaaatctccatatgggcactttggaaggctgaggtgggtggatcacctgaagtcaggagttcaagaccagcctggccaacatggcaaaatccggtctctactaaaaatacaaaaatcagccaggtgtggtggcaggcacctgtaaacccagctactcgggaggctgaggcaggagaatctcttgaacctagaaggcggaggttgcagtgagccaagatcgtgccactgcactcccaggtgacagagtgagactctgtttcaaaaaacaaaacaaaaaacttctttatgggtgtgtctctgtatgcaatttaattactgtactttggttctgtatcattccaacagatacgctttaatgtaacccatgtcctggggagtggagggccagagcaggtggctgctgcagttcctggaggcagccctgcccggggtggaaatcaaggcgctcctccccacagtggacagggacccgctgtggtggaatggaagtcagttatccttaaaagaaatcccatcaaaaaaaaaactccctttgaagtactttttttcttaaaaccaatgcaacacaaattcccccaaaaccattttccatcacagtggaatgattttctaaaaccccatgcctcttaagttctctggcatcagttagacatttttctttcccagtgccagttagttttgttgtagagagcctccgtcaccactgaaaaatattgcctactctggactgcaacatatttaaagaacggctcctattcattgtgctggtgcagagaattcccgccctatagcggaggacagcagagaaggataatgggaatcttttttttttttttttttttttttgagatggagtctcgctcgctttgtcgccaaggctggagtgctttggctcaatcttggctcactacaacttctgcctcccgggttcaagccattctcctgcctcggcctcctgaatagctgggattacaggcgcccgccaccatgcccagctaatttttctacttttagtagagatggggtttcaccatgttatccaggctagtcttgaactcctgacctcaagtgatccaccctccttggcctcccaaactgctggggttacaggcatgagccaccgcgcctggccaggaatctttattgtcaagaaaatggcgcaaatgtgccaccaaaagaagccatgtttctcaaagacttctgttcctacaagactgagtttatgacactaaggcgtgctattaagacctaaaagaacctcacgcatccatacattgaagtgacttggcttctgagacccaaggcctttgatcttctcaccagtgtccctccatatgggccgactgccactggaaaggagagtagaaacggaaacagacccgtctggacagaatccaaagtgcaaacaggaactgtgcccagagagaggaggaggtggcagaagcatgaaggctgcttagatccctatgttctaagaaagaccgctctttcctggctttaacttccttggctcagaagtttaggatttgctcaaaatcagaaaaagcaactttgggggaaaaaaaaaatctggatgtggaagaaactggcggtgaaagtcatattgagtgattaatgataaaaattatttccgctccttggttcttgagtcggtatgaaacgctggcagcctctaattaatcatcaccatgatattaacaccactgacttttcattgcttctgctactttctttctagacatctgtatcctctaagtaaatattatccgccaaaactttgttataagttgtgcaactgggttcgcccaaggcaccggagcctgcgcgcaatcgcacaggtacgcggccgcccgcggtcctcaggaagaaacgcttcgccgccgccggcaagcggggccgaagctccggcgggctcctcccgggcctgggcgcccgacctctccgcggcccgcgcccctcgggcgggcatcaaggcccggaacccgtctcagcgctcgccggggccctccccgcggagcccccgcccggcgcccccgggttcgagcccgcccccggcacccgcgcgtggagagagaggaaaagagtcagtaccggcgggcgggtgtccagctttagtctctagtttcccttcgggaggcgaagacatgacgcggcggggcttccgcggggccgaggcggcggcgcggttctcgggccgggcgggcgtgcgcgagtgagctcaggtgtgagcgccggggagcgagcgggcgggagaacgacgcgcgcgcgtggggcgccggggccgcgcgagccgggtgagtgccactgccgttaagggggcgcggccgccgcgcgccgacgtggcgcagccgagcccaccgacggcatgcgcactgacgtcaccgcggcccgcccgccctgctgggccgcgagccaagcatacggtgcgtgcgcagccggccgcgccacgtcggatgctgtggccgggggcgggggcgggggcgggggcgggggcggaggagggaggggagagaaggggtgaagaagtgagagggagaaggaaggagagggaggcggggtccccgactggctgcggggactggagttgcggaaagttaagtagggcccagctgaggatggctcctgcagcgaacgcgctcagccgggctcctggctacgcggcgacggctgggtgactgcgccccacagtgcgggccagggccggggcgtcccggcagggaggcgaccgtcccctgaggccctcagcccctgccgcggcagcgcctaatgaagcgcggaaaggagagcccagatggcagcgacgggggccgagagagcaggaatttgttaaaagacgatgcgaggggagagcctgctttccgagtgagggccagcgctggggagcagagacggtggcttctgtccctgccctcctcgttatgaaccaaaaataaaattctaagccctgcagccaacggatggaccctcccctccgcctgtggccttctaagttatcttgaaaaactagttcaggccttgatgggaagcggaagtcaaacatggcctcacaaacatccgcacggagaccctaagactaatagaggactctgataagaaacatttgcagtgtattcccggcttcatctgcatgataacaccttggtctccacaactccttcatgcaacccggacattcccttctactgagtccaggtctttagatgataactctcaaccagttgccaatcagaaaacctttaaatgtacctatgacccggacgcctccacttcacattttacctcctaaagagccaacctacatcttacgtattgattgatgtctcatgtctccctcaaatgtataaaaccaagatgtttcctggccaccctgggcacatgtcatcagaacctcctgaggttgtgtcaatgcacgtccttaaccttggcaaaataaacttcctaaattgagaccactctcagaaacttttggttttcaccatcatcttcctgttgccgtggctgacccctggctctcgtgccttggatcgtgttcttcccgcctgccccagtgttttgcaactgctgttaacttccgcaatgccttgctggattcgcattcagacaggcctaatctctttagcgaaggaaacaccacccctcgcttggctgtacttttccctttgacaacaaaactgttcagggaggctgagctcctcatctcttgtcactccctccagtccagtttgtctggttttcatcaagttctgctgcactgccctcaaccatgggaggtccttttgtggaagtcacttataacctatgtgctgccagatccaatggtcattttctactttcattctatttgagctcttagcagcacttgatgcagctggccgtccccctcctcctttgctccggaggtgccacatcactgccttaccctccagttctctggccaccctggctgctcactctgtcagcttggcagttcgccctcttctagatttataaacatttgagtatcgcaaggctcagcattggccttcttctctatctagacttcccatagatagtcacatgcagcctgtggacgactatcatgcagatgcttacaggtgccaaatctgcaacctcatttctctatttctgctcctcccctgaactccagactcaccaccaccaccacctgcagacgcttatgggtgccacatctgcaacttaatttctctctttctgcccctccactgaactccaaactcaccaccgccaccttggcttctctatttgttgtctaactcagtgctgcgcaactctgtgcatcagggcacacatggagatgcacatagcatacattggtcttgcattccccactccatacacacatttcaacaccggtaataggataattgttggccaggctgcagtcatgatatgcttgccattgtcttgcattcacatccaaacttccaagtgggtgccagcagtttagaagagaatcctgaaattaatactgggttactctttaaagagatagcacatcactcacgttcttaaaggtttaaggatacctaactgattaatttcatgagtaacttcctttttatgtatgtgcaaaagtgctatatagttaaaaacttatgtcgtatgtcttaagcctaaagaattatttcttggaagtataaaatgaaaattttaagttgaaagagcacattgtggtatcatttaattggtagtgtttttacccttagtggtacctaaaacaaagttgcatgttacgagccacagcatcttagactcaataacaaatgctattggtaaggaaccctggggggtgggggagaaagccttcacaggaaggagcagagctccagaggggccctggtggcccctggactgccctgaggtctgacaggttgtgtctctttgcctgtgacctgttctccaggtttgtactgattgggaaactctggttgtcttacagtaggtagctagtcggcctgagcagggcaggagaggactcttcccccacaacccacaccaccagaaatgttgtgtgaccatcaggtgatggtcaggaagttgttacactgtttctctaaaataataattggttgcagtcagtgccagggaaaggcagtctcccagtagatagaaaaaacctgaaagtggtggtcagcagcttcctggtaagatctctttgccacacatcgagaggcaaaatggcaacgtttgactggtatatgaccttctaggaacatgaggctggtaagggaagattgcctcaagtgagcatgtgtacacttccaataaacacactgcccctgctcactttccaagcgctggcaagtcactgtgcatgtggacagcctaccccaagggaagaatcaggggataagactgatccctgaagaatcaagggatgcaagactccagaagtatgccaatgtataaaaccctaagtcaaaggtcaaaccgtgcacttgatctctaaagttacctgcttggccatcttccaagtgtactttccttttgttccagatctaaagctttttaataaactttcactcctcctttaaagttgcctcagtctctctttctgctttatacccctcagttgaattcttccttctgaagaggcaagaattgaggttgctgcagacctgtacagattcactgccactaacgtattatatttgggtgctacgtgattcaggtacattctgctcctgacagtgtgacagccaagttaattttacatcttcaaagaactcttgatttcccacctatcggcaaatagcttctcctctagaatacaatccaagctactcattacagtgtggaataatctgtctactcaatagcatttctaatgaaggaaatactgttaagaaggtagtgaacttcgcaaaaaaaagacatttatttttcagcttcccttgtagctaggggtagccaagtgacacagttttgaccatggaaatctgctggggtgttttggggaaaatttacattcttaatatggggacaccccttcctcctggtgacatcatttgtaccaccttgaattcagacagaaggccaaaggtagaacaatcatatcgcaactgtgaggcaatcaaaggcatgaaaatcacaagctaaaggtgacagagcaggaaggtcaaaggcatgtgggaatctgagggtccatggaggcgcttcagagctgtggactcctcgtccagacttttttgttgtgtgggaaacaaatttctattaaataaagtccttgtggttggtgtcttcatgggcagccaaatgcaacccctagcacacatggcctaccagaccctgcatgatgggggtcctgcccagttgtgagctcctccctcttggctcctctggccacactggcctttctgaggttcctctagcaggacaagccaattcttccccttgggactttgtgttagccactcccactgagacagccaagcataaaggggtccgcagagaaactctgactacctgcacaccggaagatggggtggagccacagaagttcacgccctttacaggggagaggagcctgacctcttcccgggtggaatctgggattcaatctgtgacgcgggaaaccggctagcaggactcttgctttgctgaaagtccctgtttcctttttttcctttttgcctaataaattccattttccccacccttcaaagtgtctgtgagcctaatctttcgtggttatgtgacaaggacgctctttttagctaggctaacaagaaagtcctacaacaccactgccgagaactgtctcttccagatcctcgcgtagttaacttcttcttattctggaatcagcttttcaaggggcctgctctgtcttactgtctttatagcactctatcctcatctgaaattcctcatttatctgtctgctggcttattgtttttctccactgactagaatgtcagctccatgaggggagaaacctaatccatcttgcccactaggtattcccagcacctaaaaccatggtgggcacagaagaagcattcaacagttattttctccccataattctagaacatagatacatttaatttctcacaactgctacctaaatgaagagtagccaatgatgactaaacagagaatgaaaaatgtatatagcatatagatggcacatggccagtgatcttttctgacatttgctttatcttgtaaatactttgtgtgtgcatatgtgtgtgcacacgtgtgtgcatgcatgcatgggagtgtccagcccctccagccctagatgctgaggataaatgtcaggcatcacccactggtgatatagatgtactatgtagatgttctatgtagatgtacatactcagtagataggatgagaattgttgaatgaataatcttatttgcatctcacaataacagtaggagtaagatgtaccaaggaaaacaaaaacaaacaaacaaaatggagaagagaaggattgttggacttatgtgggatgcaactctggtgagtgtgacctgggacccaggctggattttctaagccccagttccattcccccaagtgagggctgacttctaaacagagttttgggaaccattttcttttcttctctaaataggctgttttctctcttttttttttttttttttaagatggggtctctttagatggggtctcactctgtcacccctgctggagtgcagtggcacgatctcagttcactgcaacctctgcctcccaggctcaggtgtttgtcccaccgcagcctcccaagtagctgggactacaggcccatgccaccacgcccagctaattcttcgtatttctggtagcggcggggatttgccatgttacccaggctggtcttgaattcttgagctcagatgatccacccataaataggctgttttctaatcccaaatggtggtaaattcacttagtgtgaatgctgtaagccctggaaaaagtatttgaagaagaaacggaaaatgcagattctcttctccagatgtgtattttgtgtccgtggctacatcactaaacctttctgagtctcagtgtcctcatctgcaagtcagagatgtgaacactaatgcctctcccaggaaggttgtgagaattaagggctttgactaaacatgattatgcccgtacagctccgtgtcaccccacttaccccctacaggatcctgagacacagggggttctctgcccttttttgatggagaaattggatctgtagctggattttctaagcttggtgcaaggattggtagctagtgtggggagacccaagagaacccagctcttgctatcttatccattgtaaatttaaaagtgttttgtaagccataatatactagagaatgtactgttattactgcaaagggagtttctttttatcagcattcatgaaatatacgaatagtcccagtgtgtattaaaataatcccacataacaatcacttcgatgaatattgctttctttattccaggctggtttctgtttcctgtcttcttgtgctgttgtctgatagatgagaattttgtattcttatttactacttctatggcttgaatgtgtctcccaaaattcatgtgttggaaacttaatccccaatgcaatggtgttgagaagtgggatctttaataagtgactggctcatgagggctctgttctcatgaatggatttatgctgttatcacaggagtgggctcccgataagaggatgaattcagccctccttcctcttctttcacgtgttctcttgcccttccaccctccaccatgggatgacacaccaagaaggccttcaccagatgtgggcccttgaccttggacttcccagcctccagaactgtgagaaataaatatttgttttttataaattacacagtctcaggtattctgttatagtagcataaaatggaccaagacaatgacccaggatttctctgatttctcctccattgttaattttgctcataaggggagagcgtcagtcattcttgactttgctttgtaacatctaggatatttcttattatactatgtagtgtaggctttaaattaattttaatgtaatttttgacatacacacatacacataaaacacttgaagaggatatacatatctcaaaatcaaataaaaatgatagaatatattttacacacacatatacacacatgtgcgtgtgcacacacacacacacacacaagtgagggatctttgggatttcactgggcctcaacttatcactcagtgacagtttcaggcatttttcaaaagtaattcaacagctaataaagagcatggaggtccattttagtcacatatgaggttatactttagttaacagtatttgaagaaaaaaataaccaggctgaaccttggcaaaatattcctcttatctttatttaaaagttagaaaatagaaactgcaaaaaagttgagagtaacacaaccatgaatattgattttctagggaatttcgaatgctttgtaagttatttataaaaaatgtgttttagcagagaaatgggaagtggtaaggaaaattttatgtctagctcttgcattgagtcattatttgaccttgtgcaagctacttatgcattctgtaattacatttccatattggaggccataatacctatcttacttgaagattcaaatagttattcaatattatgtcttagcatttacagccctcgtgctgtactatgtgcctcctagaggtagttttggcaatctcagagttttgatagcattagtgacaccatttttcagaagggctgttttcacaggctttgaagtgaagaaggtctcaaagaagaggctgttggcctgggttattttttcctccaaaggagcatgttgtatcttctcttactggccatatggacgttttgactacattcaagaaagaattaatttttatgaataagttttttaaaaaatacaaaaaaatacactttggaaaacctaaataacagattaatgtccaaaggaaaaagcaagtcaccacttctcaacaatcctaccagcaggtaaagttgaccacttgtaacattctgttgtacgtccctccaggcttccagacaaaaatagacaaggattctttttagctatcttattttgtaaattgtcccttaatttgtgtttgatgtttttctcatagttaaaaacaggagttacaggtttttggaaggaagatcatagtgacctttttttatcacattatgttaatgtgattattaacataatgttattaatatgactaatcactgaagatgtcaacctgatcacctcatgatagaaagcgtttttaagtatggccattttattagatttaagttaatttattggtgagttcagctctataataggactcaatatgaacatgggctaaattctttgtatcacaaccttgaagttccccaagaattgctaagagtctatattaacaagcctatgcctggtcatgagtctggaagatacctctgggctcttgccatctcagctttatttgctctcactattctagggttagagatggcaagtaatttccttaaaaaaatttagagctttttttttcctgctgaaattacttggttttttttttagaccatctttcttctcaacaaatgatttcctataattgattaattattccattcagggtgaagtatctgtgtgtgactttgcaggctagagagggttgtaaataatgacttctgtcggatcctagtcctcagtgtgtttgcagaaaagccagctctgttcttgctcaattttagaaaaggtccgagcttgggaagtacaattgctgttaatccagataagaacaaatcccaaagccatccttcaggtttggagggaccctctggggcaccattcacaagcttttcactgacacaagttaataaaatgcttttggccatggaaaaaataaaagaaaatatacaatttcagtagctcactggagacttacaacatgactattcacggccttaacaaagaaccacagggcatttgggtaaagaaaagctacacttagcattccaggcaaggttgtggcaaaggtataacttgacatgacatcacttagcacaaatattggggaataacatgctgggtctggcttagtttgggtttggcttatttactgttcctctgtcccttaagaatgttgttattctccttttcttttcccttctcttttcatttcagaaggagaaaccaactccaagttcttattggaatatttacagggtactggaggggctcacagtattaaggagaagactccggcagcctctgaaagaaagaaaactagggaagctctggaaacaccaataaacgacctctgtctaggacgctgctggtggatgactcaatgtgatggttcatttcatgtgtcagcttggatgggctatagggtgcaggtattgggtcaaacattattctagatgtatctgtgaagctctattttagatgagatagacactgaaatgggtgaactttgagtaaagaagagcactcgctataatgtgggtgagcctcttccaatcaggtgaagaccttagcagaaaaaaaactgactgtaggcgtcccaatctcatgagccaactccttaaaataaatctctctctgtgtgtgtctctctgtctctctctctctgtctctctctctctctctcacacacacacacacacacacacacacacacacacacaccctgttggttctgtttctctggagcaccctgactgacatgctcagttatgactttcctctctcctggatctccattccagacctgatgcagtgagcatgcaacattcttggacctgaacctactttgattcaggtgctatgctgtacatgaccttcctgggtgtaagctgaagtggagagaacatttacaacttagtgagctaatcaagcagccctgtcaactgacaaccaggatggatgtcctcataccatatcacatttggctatattctgttatctatcataagttactgatcctcctgccacgtttttctgaaatttgatttcaagagatgagggcactcctattatccagtgttttaccccagagcctatctttacccattaggaatgtaaccccttaacctcataccttgtgtaactccaagttgtaaaacacatttaacataattgcatctgctcctaaacctctcccttgtagggaatagtgttcataaattgtgcctattgttaaagacttaagctgcaaaatgacctcgtactaatttagttcatcatcgcagattatatcttacataaattctcttgctaatcagattttcagaactcagttctagtttttctcctttctaacttgcaaactgcacataaacaaaaagcaataatggctttttgtttattattgttggtaagaacacttaatgagacatctaccctcttaacaaacctttgagtaatactgtattgctaactacaggcatgacgctgtgtagcagatctctagaatgtattcatcttgcaaactgtaagatacaccaagagatatgtcttcccctctcccagcctttggcactaccattttactctgtttctatgagtttgactgttgtggcttgctcatgtaagtggggtcttgcagtatttggccgagtagtttcccactgtgcacagatgtcacattttctgtattcatctgtcgatggacacttacattgcttctgttctaatgaattcattacacaacgggaagtcttgctttccacctcctttccccccaactcccacctaccttgctggcctttctgatactaaagtctgcctgtcccatggagccagctctttccatcaacagccctacgctctctgctttgtttgatctcagttccctggtgtttgtttccacttccaactttcacttaggtgtctggagagctgagtggtccttgagggtccaaacagcaaagtacaggagctgagagactgaaaggaagtctgtccttatcatcagcccaagtgtggtggtcatggtagacatctgctgaccctgagcctccctcctggagtctcttttctgttcctacagtcccaacgctgtagtaacggagaggagggaggcatggttggctactaggctctgaaggtaaatctagaaatctcaaggccgggaagggagttgttgatttcatagactttcttttattcaagaaaatatttttgagcaccttccttttgccaggcacctttctagaaagtgaagataaagtttcagctctctcagagcttatactctagtccaatggaggccgacacagtacatggtgatgagtaacagaggtaggcttctggtattctcctctaaaacagactgaaatgctgaatgatgatccagtttctaaagctttccgatattaatataatgtgttgtttctggacagttccttggaacacattttaaaagatgaaagtcaggtgccaaggcattcatgctttatgttatgtgcaggcaagatctttcaggaagcaattttgggtagggagaggctggcttgcgtacactttatccctttcggttattcatgccagagagatggggcaagtcttttgaagacagtccttcattctctctagcaggtgtcagtaaactgtggctaaaggacaagtccagtccactgcctatttttgtaaataatgttctaatggaacacagccacatcactcacttaagtattgtctgtggccgcttttgtgctacaagagcagaattgagtagttgcaacagaggtggcatgggctgtaaagcagaagtattaatttgaccctctagagaaagtgtgtaggccccttctctacaacagtggttttagtgtggtccctggagcagtagcatctgcaccactgagaggttataaagaaatccaagttcttatcctaccatagatctgctaaatctgaaaccctgggctgggccccagcaatccatgttttcataagccctcctggtggttctaacgcatgctaaagtttgagaaccgctgaacatcactaatctatagtttctaggggactattgcctgctaggaagtcagaagcctgcagcagttttgaaatactgatatctccttattcttttacatgattgcttataaactgagtgctgtgtgtcatgatgtattgggtgatgcatttcaagagaagctatgtgtaatggcgctaatgattaagaattgtgcttacagcagaaaggatcattaactgattttataacacttatgaggactaatatttagctcattgatttgtgaacatcgcatcaatgttcctttttaaagttaaatctctttaaattaatttcgatcacagttgaggagaagacgttgactgatggcattgtgttcatgtgctgtgattgtgaacagctcctggtgttttcccaggtggccatgaatgggtctgatttatggattcccctgaaaggcacaagaaaagcatgaatgtcatggtgtccttcttggctggggtcagttgtgatgctgccactggaggctgctgcctcttgcccactgttaccctcctttaaggaagaaaaggctggcaggcagggcacacaccaagtcgagtttcagttttgggatatctgagatgtggtgtaaaggacagaatggaagggcaagccccgggagctgtcagcttgaggcctgaaataacagacttctctacttctgtgagtggattaggaaagagaagactcagtcagacttcttcaaattttcgacttggctgactcttgtttctggacattcagacttaaaacatcttcatgggcaagtgccttcctctaccttaatttcaggtttagtaattattattatgagctttttttttctcatttatattgcctgtatctcctaaatagatgggattttcatggacagcctcatgatttttttttttgccatattatcaactcaaagaaatgtatgatatcactgttccaactgattaggtagacattcatcattagggtgacaaagagaagatttcacatcttaccactctcaccccagtggttcaacaactttttaaatgattgtagatgacaggagaagtcacaggtcaggggtcactacttggatggtgattgccaatacaaccttttaatataatctgcccatatttatgttgaagcgttttatacacgtggtactttaacgctgtgtcagaaataataatgttctagctgtactgtaccattatcgctaattgtaattttattctcaactagagtacctttgagtattgtttactacagggttggtaaacagtagtctgcaaggcaggtctgacctggtgcctgtttgtgtaaagttttattggaacacagtcatgcccatttctttacatattgttcattgctgctttttggctacaatggcggggttgaggagtcgtggcagacacatttggcccccaaagtacaataaattgactctagccctttgcagaaggtttgccatcccctgctctgctgcatcacttcacacaccaacaaaggcagcagctcaaggttaggcatagacatttgtagacacaaaatcagatcacaaatgccttccttcacattttagctcacatgcaggtatcagcaaagaagaggaaacaaagtgctttgtactcagaaagtatttcagataatgaatcactttatgattttccatgatttatttttaactcttacttttccaattatttatttatttatttatttatgaaatggagtctcactgtgtcacccaggctggagtgctgtggtgcgatctcgcctcactgcagcctcctcctcccgggttcatgccattctcctgcctcagcctcccgagtagctgggactgcaggcactcgccatcacgctcgactaattttttgtatttttagtagagacagggtttcaccgtgttagccaggatggtcttgatctcctgacctcatgatccgcctgcctcggcctcccaaagtgctgggattacaggcgtgagccaccgcacctggccaagtattttaaggcttctattcaaaactaaaacgaactgttagaaaaaatgtaatatctgaaatatatcattctgaatatatttttgtaaatatctaatcacaaatggtcattttttaatggaatagtaaaggccagacttgatctaacaccagcaacagtaaacaagtgggagaaaaacaaacatctctccatgaatccaattgcgtgagtgcccttgttcactacagagtgcttttcttgatgatgaaataagaatgtctacctttagaacaattgtcattcagtgggaggtatggagtcagcctggagcacctctaaaaataaaaaaattatgaaattcagaaacttataaaattcaaacatattcccttttcctagcaggcagtaaaatgacagccgtgtgaaactcatgattacagttaagaaaggaatagaacagaggtcccatttgatcactgttggggttagacctattagaagatgcatgctctggaaaaagaagccaatgacgagagcaaaagggccgagcagccagggttgttgctgtttatgtctttgttgacctatccatccataatcatatattttgagcaccagctttgcacgaggcatcaccttagaggtaaaaaagaaaaaaatgaaataaaaataagtcttcctctagccttatcatagttctgcgaggtcttgggtctttggggagaacagagagaccccagccccagtgttcacatcgctttgccaatgcccacacttatgtgggtatctatctgcagctccatcatgccctggaatggctctaagacatgcttctgtgcttcttgctgcagctcctcccagtggccaacagcaatgatctgtcccctgtctaggggctcccatatacccactctccacctgccagcagagcccagtctgcaccctcaggtggagggacaaacacaagatgggcctgagacgggctggctgagcctgaatccagcattctaccttgatgaatctcctactctcttggctttcgattcccccagggtagagcaaggggctgtgttcagagatggatggctcctccagctttaacctgttgagtctgcacagggagccatctcctggttgcaaccaagtcagggcatggagtggagcaagagttagaggccccacagcaggagtggactccacaccaagatcctcagcttagcctgggaagtttggatttctttggttacgtttaagacacaaaactgattgaagagagattcacaatagagattatggaaactagcaaataaacggaaacattgcttccggcccgtgagtggcaggttagagatttagctgggaacctggaactttgtcttccaattctgcttctgccacttgctggctgtaagatttggggcaagttacttcacctattcatacctcagtttcttcaagagtgaaatgggaatatgaggggcctgcctcagtgggcccttgtttaaagaagctattatgtttaaagactatagaacaacacaggcaaactgtgagcacatgttaggctggtgcagcacagcctcagggaacagagagaaggccagggctctggccctcatctctaaccctgagtggtgactcaggctgctgccccaatggcctaaacagtagctgcagaggcctgacaaaacccaaaagctatacaaaggctcaggtcttggagatcagtctaggttttcactggtgagaaggaagaggcccttcagaagatcctagagaagcccccaggctctgacatccacggccagtccacaaactctctaccactgctaggcaaacaggcagcaacggctctccctccttcctcattcccaccagcctcccagtccaggcgtctttttctctttaaaggttcccagatgtgaatttgaaaggtaaggaaggagaggcagacaagagaagggaaaagatgtggttggagttgcccctgatactcacattcttctagaaagaacattcctcagcctcccactgtatgcaaggctctgagcagctgatcgtccagactagtgaaggcccagctctgttctgatgggctgagatggaagagaaagatgtgttaggcagaaagagaaaatatgtgtgtggcagaggacagaggctgcttcagacaactgcttgcaggagctacagggcatgtacgcacacacatgcacacatgtaggtgtacatgcacatatataggtacacacatgcacacacatgggcacacataggtgtacacctgcacacatgcatgcacacagtcacatgcatgaatgcacacataaacacaggcacacacacacaggccttccgcatacataaatacacacacaggtatacacacactcaggcagagctactttcagctgcatgatggtaggcagaggcagtgacagtaggaatgtccagcttacttatctgctggtgaagacccagatcaatttcccaggtggtgactttctgtccaacattagtcccctgtcttctagggttttaggcattgagaaattgacagccatgggccctggaggtctgtaattgtttagcaatcagctctctgggggtcagggatatgggggagagccctgatttgtagagtttgcccatttctgtggtgtaaacactccactcataaatgatttcaggctaccaaaataatgtcactgaaaacactgttggtaggaggcactagtagtctgctcttgtaaacaatacagctggcttaggtactaaggaatcacaagttgggtaaagtgaaggaatggttttccaaatcaaaagaccaccatgataccaaacaccaacaagaaacagaactgacacaccatctcatctactggacaaaatctacttgttcaattgataacatgtgctccagtcaactaaaacagtggagaaatcttagaaagaaaacattcccttttgatttatgacacaatgtatagttaacaaatgtagaattttttcctgtctggaaattggcaaaatgataaatattactgtataagctctgggagacatctactctgatgagattttcagttgttttgttttggttttgtttataataattttgaacagctttgtatcacactgagttaggggaaaggagaatttacgagaaatgcaccctaagtgaggccagtgtataaggatgtaccacctcacatgtgtgggatagttttgcaagagggattaatggtcatctgaaccttcagaaagactggagtgggcagcagcaaactcccccttcctgagaaattgctaagtccttctgcaagcaacagccttgtgccatcatttggcaaaatcctcatcaaacaacttctttcattcctctgcttccacccagttgttgcagctcaaatttttattaggttttctggatgtaaacttgagatggctcccaatgcaaacagagaaaactcctgttacagtccatttaaataactgcccacttgaataggggaagaggaaacacattctgtatttattcaaaagcaatggagcctcaaacaataagtgaagattataatattcttgagggaggcaaaattttcagtttcaatataaactacacaattggttatctctgtaccactcagaaagtatcccagccaaatgagtgaaatatgctctggacagccaagatcctttacagaacagcaatcaaaacaaaggaaaaaaaagagataaaaatagaacatctctccctgacactagcccccaagcacaaagctataaacctatcagaagcgtaggtttaacatctcatccttcaggaaaatattaatgaagctataagacgatcagagcttggatttatgaggcatcagcttctttccaactccagataaacattaagctccagcttataagaggaaaggagttgatgagtctgggtataatcactttaagtaaatgtagtatccaaagtctcaaaaacaaacaactcaaaaaacaaataaatacataggaaaggggcagcaaacagctgcctactttacatgtaatctggtcaagcttcacacacctccatctgcaagaggctcctgaggaggaaaccaggattcacaaaggcaaacttccacccacattctcacagctggtcagtggaagagacagaatcaaacctaaggctcttctgccttttgccatgaaaatagcatataggtctgaagaagataataaattgttggagcaggaatagaggcacccagcacttgcctcctccacaaagaaggaccaaaacagcaaacagataaccacacgtcgaatagtgcatctaggataatacactggaattcagcagggaagtggtagggacactttgaagcatggaggtggggaaagcaaagcagctggtccacctaagattggtataaagccagaaggaactccccattgtggggaaaagataggcaagagattcccaacagtccacattcccaccacagactcctgcaatactggtcatgagagaaccccttggccttcacaggccctgagactagtacagggagctgcctggagtatacatgactgcattgtcctagagaggaaatgctggatccttctcattccttaagacccaagctgctatggcatggcaccattttgagagtccagcctccaccagactacattctgccctggagcccaatatcccctgcatctccacatccatggagtaccccctgagctgcccccatgtccacccagaggtctttagcatcacaacaccatctggacccagtggtttggctggatcctcagcactctagcccatgcagtgtcctatggccacacagagagcaggcagtgcaccacacaggaaggctaccctcagaacagagggagcccaagtgcatgctctccagagcctgggagccacctgcccagggctgctgccaccagaagcaccccacccctccagtagtggggccactgcacacctgcatgctgtccagctccagtctacagctcccagcgtgagcaacacagaagacgggtgatttctgcatttccaactgaggtactgggttcatctcactggggcttgttggacagtgggtgcagcccatggagtgtgagccaaagcagggcggggcatcgcctcacctgggaagtgcaaggggtcagggaattccctttcctaggcaagggaagctgtgacagacagtatttggaaaatcagaacactcccaccctaatactacgctcttccaatggtcttagcaaacagcacaccaggagattatattccgtgcctggctcagagggtcccatgcccaaggagccttgctcactgctagcacagcagtctgagatagaactgcaaggaggcagtgaggctgggggaggggcgtccgccattgctgaggcttgagtaagtaaacaaagcatctgggaagctcgaactgggtggagcccgccgcagctcaagaaggcctgcctgcctctgtagactccacctctgggggcagggcatagctgaacaaaaggaagcagaaatttttgcagacttaaacattcctgtctgacagctttgaagagagtagtggttctcccagcatagagtttgagatctgagaatggacagagtgcctcctcaagatggtccctgacccccaagtagcctaactgggagacatgtcccagtaggggctgactgacacctcatacatctgggtgcctctctaagatgaagcttccagaggaaggatcaggcagcaacatttgccgttctgcaatatttgctgttctgcagcctctgctggtgatacccaggcaaacagggtctggagtggacctccagcaaactccaacagacctgcagctgagggtcatgactgttagaaggaaaactaacaaacagaaaggacatccacaccaaaaccccatctgtacgtcaccatcatcaaagatcaaaggtagataaaaccacaaagatggggagaaaccagagcagaaaaggtgaaaattctaaaaatcagagcacctcttctcctccaaaggaacacagctcctcaccagcaacagaacaaagctggacagagaatgactttgatgagatgagaggagaaggcttcagatgattggtaataataaactactctgagctaaaggaggttgtttgaacccatcggaaagaagctgaaaaccttgaaaaaagattagacaaatggctaactagaataaataagcatagagagtaccttttttttttttgagatggagtctcgctctgtcgcccaggctggagtgcagtggcagaatctcggctcactgcaagctctgccgcccgggtttatgccattctcctgcctcagcctcctgagtagctaggactacaggcacccaccaccacacctggctaattttttgtatttttagtagagatggggtttcaccgtgttagccaggatggtctcaatctcctgacctcgtgatccgcccacctcggcctcccaaagtgcggggattacaggtgtgagccactgcgcctggcccaagaagaccttaaatgacctgatggagcagaaaaccatggcacaagaactacatgatgcatgcacaagcttcagttgctgattcaatcaagtggaagaaagggtatcagtgattgaagatcagatgaaagaaatgaagtgagaagagaagtttggagaaaaaagagtaaaaataaatgaacaaagcctccaagaaatatgggactatgtgaaaagaccaaatctacgtctgattggtgtacctgaaagtgacgaggagaatggaaccaagctggaaaacactctgcaggatattatctaggagaacttccccaatctagcaaggcaggccaacattcaaattcaggaagtacagagaacaccacaaagatactctttgagaagagcaactccaagacacataattgtcagattcaccaaagttgaaatgaaggaaaaaatgttaagggcagccatagagaaaggtcgggttacccacaaagggaagcccatcagactaacagtggatctctcggcagaagctctacaagccagaagagagtgggggccaatattcaatattcttaaaggaaagaattttcaacccagaatttcatatccagccaaactaaacttcataagtgaaggagaaataaaatactttacagacaaacaaatgctaggagattttgtcaccaccaggcctgccctaaaagagctcctgaaggaagcactaaacatggaaaggaaaaactggtaccagccgctgcaaaaacacgccaaattgtaaagaccatcaatgctaggaagaaactacatcaactaatgagcaaaataaccagctaacatcataatgacaggatcaaattcacacataacaatattaaccttaaatgtaaatggactaaatgctccagttaaaagacacagactggcaaattggataaagagtcaagacccatcagtgtgctgtgttcaggagacccatctcacgtgcagagacacacataggctcaaaataaagggatgaaggaagatctaccaagcaaatggaaaacaaaaaaaaaaagcagggttgcaatcctagtctctgataaaacagactttaaaccaacaaagatcaaaagactcaaagaaggccattacataatggtaaagggatcaattcaacaagaagaattaactttcctaaatatatatgcacccaataaaggaagacccagattcataaagcaagtccttagagacctacgaagagacttagactcccacacaataataatgggagactttaacaccccactgtcaacattagacagatcaatgagacagaaagttaacaaggatatccaggaattgaactcagctctgcaccaagcagacctaatagacatctacagaactctccaccccaaatcaacggaatatacattcttctcagcaccacatcacacttattctaaaattgaccacatagttggaagtaaagcactcctcagcaaatgtaaaagaacagaaattataacaaactgtctctcagaccacagtgcaatcaaactacaactcaggattaagaaactcactcaaaactgctcgactacatggaaactgaacaacctgctcctgaatgactactgggtacataatgaaatgaaggcagaaataaagatgttctttgaaaccaataggaacaaagacacaacataccagaatctctgggacacatttaaagcagtgtgtagagggaaatttatagcactaaatgcccacaagagaaagcaggaaagatctaaaattgacaccctaacatcacaattaaaagaactagagaagcaagagcaaacacattcaaaactagtggaaggcaagaaataactaagatcagagcagaactgaaggaaatagagacacaaaaaacctttcaaaaaaatcaatgaatccaggagctggctttttgaaaagatcagcaaaattgatagaccactagcaagactaataaagaagaaaagagagaagaatcaaatagatgcaataaaaaatgataaaggggatatcaccatcaatcatacagaaatacagactaccatcagagaatactataaacacctctacgcaaataaactagaaaatctagaagaaatggatgaattcctggatacatacaccctcccaagactaaaccaggaagatgttgaatccctgaatagaccaataacaggctctgaaattcaggcaataattaatagcctaccaaccaaaaaaagtccaggaccagatggattcacagctgaattctaccagagatacaaagaggagctggtaccattccttctgaaactattccaatcaatagaaaaagagggctgaggtgatggggttttctaaatatacaatcatgtcatctgcaaacagggacaatttgacttcatcttttcctaattgaataccctttatttctttctcctgcctgattgccctggccagaacttccaacactatgttgaataggagtggtgagagagggcatccctgtcttgtgccagttttcaaagggaatgcttccagttttagccaccacacctggctaattttttgtatttttagtagatacggggtttcaccatgttagccaggatggtctcgatcaggaaagggaattcttatacactgttggtgggaatgtaaattagtgcagccattgtagaaaacagtgtagagatatcaaaaaaacaagaatagaactaccatacaatctagcaatcctactactgggtgtttatccaaaagaaaaaaagtcacagattgcttgagttcaggagttcaagatcagcctgggcaacatggcaaaaccccgtctctacaaagaatacaaaaattaaccaggtgtggtaacatgcgcctgtagtcccagatacttagagggctgaggtggtaggatttctttagcctaggaggtagaggcatattatgccactgcactgcagcctgggtgacagtgagatcaggtctttaaaaacacacacacacacacacacacacacacacacacacacacacacacacacatacatgaaaggaaattagcatatccaagggataactgcattcccatgtttactgcagcactatttgcaatagcaaagatatagaatcaatgtaagtgtccatcaacaggcaaatggataaagaaaatctgtatatatacacaattgaatattattgagccatttaaaaagaataaaatcttgtaattcatggtaaatggatgagcttagagaccacaatgttaagtgaaatgtcaggcacaggaagatatgtactacatgttctctcttatatgtgggagttaataaaaaatttgagttcatggaagtagagagtagaatcgtgagtatcagaggttggggagagtaaaggggagagggagatagggaggatctggttaatggatacaaaattacagctagacagaataagttcaagtgttctatattgctgtagggtgactacagttaacaaaaatttattatatattttcaaattagtagaagaaaggattttgaatgttcatgatatgaagaaataaatgttcgagataatgggtatgctaattaccctgatttgatcattacacactgtatacatgtattgaaatatttctctgtatcccataaagatgcacaacatatagaataaaaaaagaatcaaacccaagttttcctggctcaagattacttatcttttcaccatgtcaggagggtgccccattatcaaaagtattatttacataacaaccttttaaaaaaataacttccccttcatcaatttaaaagctataagcatttcattttgtgcactttctagaaacttgtaccttaaaagcactgaggtgaatttattttctgagttgcaggggaaacagatagaacaggggtagagaaagatacaaccttgtgttcaccagaaggctgagacattaggatcctgaggccttcaagttgagtccttcctctaccattttggagctgtgtaatcttcagcaagttagtaaacctctctgaatctcagctgtcctcctttgtaaactggagtgaataatagatatcactgcatgtaataggcatcactgttcaaagtgtttgattagataaactaggtcttgcttggcacatacagaaggctgtgattttcagctattatttctgtattcatcaatcctaagatgcattttttttcacaatttaacattttttcagtgcatctgactgcctatggcatctgtgtcaaattttaatgtgtcactgtgtcaaattttaatgatgcatcttacaatcagtggagtcttgatttgatgaattgtggtcttgtaattatcagtactattattaccaaagagatctggccataaaataataatgagactgtttccacaagctgtagacaataagcaccttattattttataatagcatggcacaaatttcctgctggaagactctcctgggggcttccatgtaatggctaagatggatgaatattgccttctggcagtaatggactttctgtaggtctgtcttatgttaagcaatctcaagatgtgaaaatccagatttctgttttaaaaattaattagaaggtgacacttcaaaatagaagagcttcacaaaagtatccatttggagcagtatttctcaatatttctttcctcattacctccctccccaataacaaggctttttagacatttttgtcctaatcactcccccaatgaaattttaatattgaagacatactgtatacctatttatgtattgtttgtatattttttcttaacacatgaaatgatatataaaagatgtataaaagagtaccatttgttgcacacaccctctcattcaaattttcacccccttgagtacaatatctcctctttgagaatgcatacattagagacagaccttaaaggacatttaaaatatcgtatggctttggaaattttaatttgcactcaattttcctaggacacatcaactacagataggaaggcatacaagtatattagataaaatgtcaccgtggggtgtccactccatgttgattacaggctaatgtctgcctagttgttttttagaccatgctacccaaccaaaacaccaggaggaagggacacctgtgagccatttgtaattcctataatggaagaaaacttgtctcaaagttaagttgacttttaaaaatgtgcctaggtgttattcaatcacagcatttcatttgttaacgttatttctacaatggctcccaaatattttttcttttctcacattattatttctttaataccagaaatcaacaccctgatcaaaagtttccagaaatattccctatagttgaaccccaagggaaggattctttatatccatcatcttaagggccatggtcagacgaaagttccctgggccctcacctgccttcaggccccgggccttagaggaaggactcttgaagcagcacaaaaagctgcttcctgtttcccacttcccacttcctgcttctggcttcccacttcctgcttcctgcttctggctttggctgagcatccgaaggaggaacaatgctgggttcctgggctatggtgcttttgcctcagagtggatgggggaaaccgtggcagaggcttggtccagaagatgggcagaggtactcagggggccaggctcaggccaccccaccccactgctcaggagataggcagtttagtttgatgtttgaaataccatttcaagaggcccgccactccactatgaggtaaatagcctaaaatgttaaaaataaaacaaacatctccactaaaaatacaaaaattaggcagatgtcgtggcacgcacctgtaatcccagctactcaggaggctgaggcaggagaattacttgaacctgggaggtggaggttgcagtgagcagagattgcaccattgcactccagcctgggcaaaagagtgagactctgtctcaaaaaaataaataaataaaaaataaaataaaaataaaataataaaacaaaaaacacaggctgtgagaattttcatctgagttttagcttagtacaaggactctggaagactctggagcattcaccgtggctatcatctgtgtctttctgagccttgggaaaagcaaggtacctgcttagaggcttttctcctttctggggcttgatgaccttgtgtcacccttccatgcagtggaaggactattccactgtgacagtatttactctgttatgtaccccaaacctggctacctccatgcctcactgaagcaggcagggccagtgctgtccttgacactcctttttccttgtgcaatgctgtgttggggtctctgacttggaaggaggttggccaagttcaaggttcacaaggatgcctgtacccagccattctgccagcagactgcagacatatgagccagccaagctgagaacgctgagcctggcctaggtcagcagaacctccccacccaactcagaaatgacacactgacacatggttgtgtgtgtgtgtgtgtttcagagtctcactctgttgcccaggctggagtgcagtggcgtgatctcagctctctgcaacccccatctcccaggttcaagcaattctcctgcctcagcctcccgagtagccgggattacaggtacgtgccaccacgcccgtctaatttttgtatttttagtagagacagggtttcgccatgttggccaggctggtcttgaactcctgacctcaggtgatccacctgccttggcatcccaaagtgctgggattacaggcatgagccaccacacccggccggttgtggttttcaggcagtgtatttgggggtattgtgttgctcattgataactaattgaaacacctggagcacaataaacattgagtaaatgtagctagcatctttagctttttattcagctccccatgtaagtactggtttctccatggtgagcctccgccccttcctgcgtgactgtcctcgctagtccctgctggcctctgctgtccatgctaagcacaggttcaaccagcttcataggcactgaacatcctctgcgtcatgcttttcattcctgacacacagttcaaggaaaaacaaacccaaagtggcttttcctaatagaagaaagcgtagaatatataaattcccagaaccagattttcacacaatgaaggcaaggtgagaactccttgattccagccactgctgtctgatgtcagtttgacttccttttatttcttttaagcagggaaatgaacattaatcttcaccctcacaattgtcccaggcaagccacaaagtgctgagcacaaggggaaggctggctaagtatgtgtggagtggaattggattagatggggagaaactctggttacctctgaacttgatttctacttgggccagctatgtgccgtttgaccttggcccaaacagccctcctctctatctgtgctgcttcttctgtaaaataggaataattacgtcagctcaactcatctcatccattgttgcaaggagtaaattagatggcacgtgtgaaaatgctttgtaaactactgagaactgtgtaatgcattgtaaggcattgtcatgattgctactatttcaagtccaatgggggagattggatcgaagaagaatggcagacagcccagggttgtgggggcagtgaggctgacttgtttatcagtagaaaaagcattctgactcatctcagaaaagaatcttggcaaacacaaagaaaatagtctggagaaagctgatgagcccacagttggaattctgtattggggtttagaaatgtgagcaccaggatgctgaaaacatgagcaccaggatgctgaaaacattgaaaagagtccaggcaaaagcagggcagttactagagaacagaagtctcaacttgtgaagaattcagtgtgaaacacatgcgctttggccaccaggaaattatacttgtttgcccaagttttttccaagaggaagatgcttcagggatatgtaacacgctcttgtggaaagaatgctggtttataggcctctgcacagggactcccctaaacctctaccccaagtctggatgaagaaaacagtgagaggtgcaccagatgaggagccaaagcttttcacaagaaccaaataatgttttaccagttagggtgcttttggctgtaagtaatagaccagataacaaagaagctaaggtcatttattatttccttcacaagaagttcagagataggccagtaccaggcttggttaactcagcagtgcaacaaaatcctctaaaactcaattcctccccccttctctctctgcgatcctcgtgggcttgatttatccttttagggttggcttccctcatgatgcagagatggctatgacaattccaggcatgccatgtagatgacaacatctctgtccctttttaagagtaagggataatttcccagaggttccccagcagattcttacttccactgcccttgaccatgactgtgatctctttccaagctgtattagtccgggttctcctgagaaacagaactaataggagatagatatatttatgtacatacactcaagtgtgtatgtgtttgtgtgtgtgtgtatatatataaaataaagaattggcttacatgattatggaggctgaaatgtccccagatctgcagtgcaaaggcctgagattcaggagagctaatgatgttaagttctagcatgagtccaaagcagaagagagacgtcccagcccaaagtcaggcaggcagagagagcaaattctctcttgctcagccttttgttctaatcaggccttcaacagattggatgaggcccatccacattggggagggcaatctgcttcactcagtctaccaattcccatgctaatctcacctggaaacaccatcacagactcacccagaaataaagtttacccaaatatccagatgcctcatggcacagtcaagttgacacaacagtaaccatcacacaatcttaaactagccaccaacaaggggagtaaaatgactatgaatggccgagaccaatcccaattcactctagggctagagggggagctcagcccccagaagctcaaggccttccagtccctggacacagctggggttctgttggcaagtaatagggggaagagctgtggggcagtgaccaagaatggctgcaccctctgctccatgtaactcaccgaggaggtccccaaaatgtaatgcatgacaggatgttagctaacacttgctgggcacgtactctgcactaggtgtggtactaagcacttggtaggtgtcatctcattcaatcagtttaacaacctgaagctccttgtgttgggctttgttgggaggtgagatggaccttaataactgaatcttcctggaagagcccagggttaatcctcttaatatcaaattgctctccataaataactgctttgctgtggttcttgtgaattccttcttcttttctttctagtagttgacttcactttagacaactgcaatttctactctggcatgatttctcagaggcggtcctcaacaaacatgcctggggtcagggagagagtccagtgatatgaaaaactagcccagaatggaaaactccttgaagttctgcaattatatattattttttattttgtttttgattttttgaattgaatttgatttgttgaataaattaattcaagcaatacaaaagtactgttgagagcaagtgtgcctcccaccttagtccctgcccaaatcagctctcccatggatccattcatccttcccttcctagttattgataaactattgttacgcaaaggtctgtgccaggttcaagctgactcgtggagttccaatggagttatctttagttcttccctcccacacaggaagcacccatcaggtgccaagtcctaaacatccatcttgacaaaatctctgaagtcctcattccctgtttgtttattgtttctccttggactcattctgccagcctccagtggcctccatgacaacattgcctccttctctgttgtctccgtcttctttaagtgcattttttataaagatacactacgttataggtggaatactgtgtcgctccaaatgcacacgttgatgttctaacccagtaactcagaatgtcactgtagttgcaggtagggtctttaaagaggcaattaaatttaagtgaggtctttgaggtgagccctaatccaatctgaccggtgtccttaatagtaagaggtgattaggacacagacacacacagggatagaccatgtgaagacacagggagaagacggctatctacaagctgaggactgaggcctcagaagaaacaagacctagtgacgctttgatattagacttccagcctccagaactgtgagaacataaatttgtgtttgagccacacggtgtgtggcactttgttatggaaggcctcgcgggcaaacacagactacgtacaatccagccactcacttgctgaaagctctgtagtggcttctggctgtttaacagtgaggcagcactggcccacctctcagggcccttctgatctggcgtggacctgcctctactgtcccgcttgcttaccatccatgctctgggcttcagctcacactgggctgattcccatccagggaacacggctgtgcttccttgcctttcgcctttgcacaggctgttccctctgcaaaaaacatatttgcatttcccatcacgcccctcccatttctacctgttgaaatcacgtccatcactcaaacccagccacagtgccatctcctttagaaaggcatatgctttcctaaagccacaatctagttgggtccctccttttcacctccctcattgttacaggtagtcagacagcatgagcagggcagaagagggctctcccatccactaggaaggttgggtaatggttcagcaacgatcacaatgcctctctaaaaatggtaaattggcagccagtgccagggagaggccatttcctgctggcccacacctgttgcactaaagtgttcactgaatgcagacaccagggagaagcaacttcctgagcatatacataaagagacaaaatggcagagtatgaccttccaagggcaccccacaggaaagggaagaaagcctcagatgggcatgtgcacagcttcctaaacacactgtgggtgctcacttcccaagggtaaggggagcactgtgtatgtgggcagcccagcctaacggaagaatcgtggaaaaggggcagcctataaggccctagcatcaaggttaaacaccgcacttgttcttcaagtcacccgcttgggtttcttccaagcctactttcctttctttcctgttctaaagtcttttaaaataaacttacactcctgctccaaaacttccttggtctctttttctaccttatgcctctcagtcaaattctttcttctttttttttttttttttagatggagtcttgctctgtcttcaggctggggtgcagtgacgtgatctcggctcactgcaacctctgcctcccgggttcaagcaattctcctgcctcagcctcctgagtacctgggactataggcatgtgccaccacgtccagctaatttttgtatttttagtagagatggggtttcaccacgttggtgagaatggtcttggtctcctgacctcatgatccacctgcttgggcctcccaaagtgctgggattacaggtgtgagcgaccgtgcccggctaaattctttcttctgtggaggcaagaattgaggttgctgcaggcccatatggattcgccagtaactcagacatcttccaccagggtaacaccatcatcatttgtaaaagtctcatgccgggatcagacctgccccgtattctattcaggtgtgcactcagttgccttcctatttgacttgctcacctttcagcgtgtcatctaggaggactagacaagtagcacattttcacaaacacgaatggaatgaacatgacaggccagattggaaaataggatcaaaaataagtcaaaaaatgaaaattatgtctatggaaaaaaagaaataggaaacacgactcaaattgtgtcaaccctaggatgacctgcaggaagttgaaaccctgggtgggagaagtactgaatagaagagagaatgctgctcccctgacactgcagctatatcggaaaatacattctaagtctacttaagatagaattccggttgaatattctgaaatgtgttcttacatggaagacatttgacccctggagacaactcaacagaagctttgccttggaaagctggttggatggagaggttttgtgaggtctttttactctggaatctgagatgcctggtggaacttgagcagcactgttcagcagggggcaggccaccaagagcacacatatacccttaaaaaccatctgctctgcaaacatgcagaaatcattaatacattgcaagcgtggttttgcccagacctgctgcaaaatgatcacaggcaaagtggtttgcgtactctccccctcactgatggctctttgggccgtcagttgaacaaggaacccacacggagctaaaatgtacaaacgacaaataaaatgttgcctctctctccagactctcacaaaatcaggaaaaacaaaaaaaacctttctttccatttctgcaagaaagaaatgagagctaaaactgttagccatgtgaaatctagtggggaaacctgttttttttttcctatgagtcttaaagcagcaataatttgttttcctttcttttcctttcttttttctcccctctgccacattagagaggcttgctgacaaagacttgagtaggttctataaggagccccaggcatccccagatgtggtgcacattgagatggatggagaagttgtgtatggcggaggaaactaggagtgccgcaggatagaaatccactgggagtaagacgggttggtgtccctctggaatccgtgttgctgccactgctcggtagagaagggtgggtggagtcatgtccctggaacctgcctgacagtgttgccagttctcctgcttcacttctggggctgcccccgtgtccctgatgtcaaagccatgaagttacttctgggaggggagaaatcaagctggagaccctgagacaggggtgaaatcagaacctgctgcgctggtggaatttggcagatgcctccatgctgtgaaggggccatgggcaccgaaaggtctccccacccctgcaccctctcactctgatgccaagggcctttagttccccagaagcagaactggagctggggaagactacatgagggattcatgaagccagaattcttaggaggaggagggatcaggaagacacacggtggaaggcacggggctaggtggggatgtggcctctgctggagaccaacttctgccggatcccatggcagctccatcgggtcccttttgaggtgaggacattggccttttgtatctctatgttttgtctttgaccactggccatggtgatggtgttgggtgactgacaaggtagctctgtgctgggctgcacttccttccgctgaaagtcattaggatgcctcgcggctccttgtgaggttggacatggcggatgagcactgaaggtggcaggatgcttcagtacagagacagatggtagatgttctggcttttcaggccacctgatatggttaggctttgtgcccccactcaaatctcatctggaattgtaatccccataatgcccatgtgttcagagagagaccaggtggaggtaattgaatcatgagagtggttcccccatgctgttctcatgatggtgagttctcacgagagttgatggttttataaggggctcttccctgcttaactaggcattctccttcctgccacctcgtgaagaaggtgccttgcatccctgttgccttccaccatgattgtaagtttcctgaggcctccctagccatgcagaactgtgagtcaattaaacctcttctctttattaattacctagtctcgggcagttcttatagcagtgtgagaatggaccaatacaccacctgtggtctctgttgtatattcttttttgttttatttcaccactctttatagaaactccatcattggcctgagagccacacagaaacaatccctgattgactaaatccattaattcataagggattgcaaaatggtgatggcctaactcttcacgcttcattcactagctgaattatttctataaagaaaaagattctgccagtcacctatttaataccctgagggacagttcatttaggaaagacacgataaatgcttggatttttctgtttacttactatcttagcccattccaggctgctataacaatacacatgagactgggtgattgataaagaacacacactcatttctcaccattttggaggctggaagtccaggatcaaggcacctagagttttgttgtttgatgagggcctgttctctgcttccaagatagagccttgttgccagaggtgatcaatactgtattctcatgtggcaggagagatggaggggccaaaggcctggctagttccccagagccctttcataagggttctaatcccattcatgaaggcagagccctcacaatctaaccacctcccaaaggccaacctcttaatactgttatcacactgggtcttaggttcccatgtatgcatttttggggatacatacattcagatcatagcatgtactgattttaataataatgagtttgtttctagacattctccagagataatcaagattttttttttttcctcttagtataattgtgaacttagggatgtaagcatattgacaggttcaggatcaaatttgccatctttgggcagtttggcctctgaatatttttcaacagttttattgagatatataattcacatacagtacaaacacccatttaaagggcacaattcaatggtttttagtatattcacagagttgcacaaccatcaccacaattaattttagaacatttttgtcatccccgaaagaaaccctgtacccaccagcagtcattctccatttccctccacctacctcttccatccctgtaccccacccccagacctaggcaaccactaatccactttctagacgagactgttctggacaattcatatacactgaatgatataataggcggtcttttgtgactggctgctttcatttagtaaaatgttttcaagggtcctctacattgtagcatgtatcaatatttcatttcttctaattgccaattaatattccattctgtggatgtaccactttgtatttatccatccattggttgatggacatttggttgtttcctcttggcttctgagtctttttgatagctccctagcagtctttggcagcttccttcctttctagcataatacgaagttccagactcttcttatatatgtctaccgcaggcttgggaaaactcactctccaaggagcacatattcgttttaatgggaaatgcaatgtcaagataaaacctgggtgctagggatgtttattgttactgggctggtcattgattctaggacttgcaacagacagagacaaaacatttttttggttgtttacttgtttgtttatttgctgtttaagataaactttacctggtgaatgtcctgaagcttccagttcaaagttaggaccacagagtttttacttagcttcatcaatattacaattgtatttttttctatgctaaaatgtcagattctcagtgacaccaaagtaatgactcatttgcattatcccataagacacgcagacacaagtttcatgtcgcaatatcaaaacttgtgggagcaatgtatttactgaaaacagtttaaaatttgttcaaagttatttttgccttacagatttgtcactggagatgtacagttggaaatgtattttaacggcatttggaatagttcctctttgtggttatgctatcaactggttgccacttaagttcatttagttcactttatttttgatttttagagattgattttatagaaattaattttgttttctaattatgttctaaagttaaaactacaaggtaagatttattcaaagaagtccggcttctattcctgtcccttctattttactcccttttgtttcgataaggcaaccactaaagacaattatcttcttttactttaaattttaagcaaattctatatatatgttcaatcccccttcttagactactgtatttactattctccatcttgcttttctcattggaccataaatcttggagatcacttcataatggaaatctttcttagtcttttttaacagctgcatagtaccctaatactttctatatgcaccccagttaattcaccttgtacctgattgacagacatttggattgttccaagttttatgcagtctcacaaatagtgctgcaatgaatcgcctatacattttcagatttttgccagaatatcattggctaagagcatagaagtgggatagccaagctaaaggagcatactttgtgtaacttgggtttttctaaggcatgatttccgttaggggttgcaaaacggtgataggtatttaaattttatcattctttatttattagctagaacagctctataaaaagaaagctccccttaccacctctttgactacactgagggacagtccatttaggaaaggcaggacaaatgcttgattctttttacttactgattttcacaaaaatgaattggttctcaggcaacttccagaggtaatcaatgaagatttgtttgcccacatgtatcattatgaacatataaattcaatcatatttgatgtgtttaaatccaatgtcatcttagtataatattaatttcctttattataagtgaggttgggcaccatttcatgtgcctaagagtcagtcacattaattctttcataaactatctgctcatatttctagactactgttggtcaagttgtgagcctttttttctctttttagaatctcttttatatattgttattgacttttgatacatgtgttttttcttagtttatcatttcccttttctactttgcttatgctgttaatttttcataaaaaaggttttttggtgatcaaattaatcaaatgttatatttaatgcttcagatttcaagtcataattaggaaagttttcttcattcgcaggataaagaggaattcagccacatttccttctagtaccttatggtttggtttcgtttttacatttaaatacataccatttgaaatttatcctatcatatagcatgagtaaagattccattttattttcttccatatggctatccagttatcctaacaccacctgtgaaagagtctatcttttccctactgacttcagattttgactttattgtatactacattttaataatcacataagtctgtttctagagtttatattctgaatcatgtgtacctatttaagcattaatataaagcttttgaaatgatggcagctttgtaggaagttttaatatctgagaggtctttccaccaccctccctgccattcctctcctttcttaagctgctatgcttactcgtatgttaatacaaatacattctatataatcagcctgtctggcctaggtaaaaaacttgggaatttttcaactttgtattacattacatttcatttatatgttagcttagtgagttctgatttttttttttttttatgctgagtcttcctatacaaggacatggagtgtctttccatttgttcaagtctacttttgtgcctctctcgtgagtgttttatggttttcttcatgcaggttttgggcacttctttgctaccacaaatgtggtggtctcttctatcttcttactggtttttgtttacaatatatgatgagtatttatttttctttgttaattctaaaaattgctcccttcctaacactgctctcagtgttatagtatcttttcctttgattcttttgaattttccagatacataatcataaagtgaaaaattttttatattagaaactccaagggaatgtttgaaacacggatctctgagaaagtgtgtcccttgtgaaccatgggaatgaagtcaaggcagttgccacaacttgttggcaacatgctagaaaaatatatattcaaggaaaggaaatatagctttttaaggactctaatgacaatctcaaagctttaaggttggagacaacattgcaaaaatatagaattattaattgtctttgtctctctactctttttctgacagcccttccttctccatgtcctttactcctttgttttatatattgccacagcatacagaaatgttcttccctcacagatcctacatctttctaccttcttagcttcttcttttagctcctccttgctcttttgcctgcatcttctattccttttattcctctattttttttgtcatatgtgtttatttcccattggtaaggacattggagtataactagtattaagcaaaaaaaaaaaaaagtcaaatccagaaaatgtcttgaaatactattataaaacattacactatacatgtctttaataatgttcctagaaaaacttatttttgtgtaaaacacatagtacatagtacagcttatcctaaagattgtagataataagaataatggtgaaaatctccatttagtgggcaattcctaagtgccagatacaatgctgtgtactgtactaaaaactcatctattcattctataaatattgattgagttccaggcagtattcattctgctgtggataaaatagatgaaatctctgccctcattgaacttacattctaggaagaagacataaaatgatgaaatattataaatcaataagatacgatcaatgctagctctactcttctaggaggcagaggttgaagcaaggatttgggaggtgcaaggctggacttggagaatatagaaaggagaggagagagataagagatgtgaggctgggagactcaggcaggagaatcgcttgaacccgggaggtggaagttgcagtgagctgagatcgcgccactgcactccagcctgggtgacagagcaagacgccattaaaaaaaaaaaaaaaaagaaaagagagatgtgaagcaatgtgatgtatattgagttggctgcagcatcatgagctgccaataggcacagcaggttgcatcttctttggcttgtcagagttctagggaaggatggcaaggaggaactgcatcttggtatattcacaaaaggcaggggtttattagcctggctccctcccatcttctcttttgcattggtgaaaggccaccctatgtggaattaacttcctcacattgccagattgtaccttctggacctctggtcgtctaccggaaaaccacacccaacccaagtctagtggcagatgggtgacccagcagaagtagggtgctgaccaagagaaaggaagaagggtgaagtcgaggtgaacaaaatgtgctggcttgtgcccattgtggctgacacagtcctcaggagggagagacacaacagatgaaatcagagaggtaaggagggtggggagtggacagatcctgtggaaacttctaagttcttgcaaggacattgctttttactttgcatgagctgggaagccattgaagggaggtgttggagcagaggagtgacatgatgggactcatgcttttaaaggaccatgacaaccctgcaaagttagtaattcaggctttagaattgaaataatttcccgaaggtcacagagagaggtagtagagtcaggatttgaacccaggtcctcttactctaaagtccttgtgctatctagtaggggcatttcctttctaatatattagttgcaaactttttattcatttataaatttatatattgattttatgcctcctttttgagcctgtacatttctgcttgatggagagtagaatggtgttaggtctgtgtttcttcattcattccaaaaatatgcattcattccctgctgtgtgcatggcatcataaattgtgctacaaagaataaaaaggtggacaaggtcctttctctcaagaaacgtatagactagctataaagagaagacaggatttgtatttaaattatttaagtccaatgattttcacttttgggggggttcttgcttatttcatagaattccctaaaagaaaattgctatttcttttaaagaacagccccatctgagagctggcagcagacaaaatatgggattccctcttcgattttatagattttgacttccagcttgactgttcagttagcacattaaaagatgactccctccctccccaaccctaagcctcgcaaacccaacctgtgatcagaaaatccagctgtgcactttctatttcttgcctcattgccaggaataaagattcagcaatctctgcctaaccgacaatgttgtcagtgacacctgaggcaaagtaaaaacagctcagcagttctgcagccgctgagccgctgagctgctgtggcattgcattagtcaaagcaaggattcctaggcagcccccctcctccctcccatctctcactggggggcagcttctgctgcagtgggcaagaatattcagtatcagaatctgctcctctcattttgatgaggaactgtgacagggctaaatgtcaaatcttgatccaaagactgttctgtttgccttcagccagtatttcaagtattttcaggacttgagtcgtacagtcatgccctttgttttcctgcagaagactcaggcaagcaacacattttaggacaacagccctggataaggattcaggacacatgggcttcagatctgcctctagcaccatctgcctgtggactgcccactctccaaggagtacgccatgaaggcctctaagttcctgtaccctacatgagctttgtttgggtcttgcagaatccccaacgggaggccaacagagtcatacctggcctttgcagctctgaaaattcccacatgagaaagcgcatccatattccgcttgagtttgcctcctttttctgtgtgaacatgcaaactctctctggctctacagattagaataaaccctctcatgacccttaccagaaatacacaacgattttcatcttagccagtttgttctcagctaatacatccttttgagcctctttgtttttttgtcttcatatgcatttgtttattttcctttggtagaaacattggagtataattaggactaagctgtggttttgtatagctacccttaacattctatatcctggacttgttatcctttgcttatgactgttatccacaggttcttcttacatggctgtgcaagtcacttattcattcattcgttcaattaatatatgtttattaagagtttattacatgccaggtgctatgaaacccagcatccaccctgcctctcttgggaggctgatggttctggggtttatatatatgcctattcgagtatctttcctatttgaatatctttgctgtgatactcaaataggaatagatactatttaagtgtcacaggaataggcatatatatatagacctataatgcctatttgagtatctattcctatttgagtgtctttcctgtgacaactttacaaaaaaagatgactttcagagagctataactttttcttcgtttttactgatcatgtttctataccttaaaacttctccaagattcagtatttagaagttattacaaattcttcatttatttgtatggaaaaatctacttagcaatggtgaacttttttttatccccaaagtaccaaaaaagatagaaatgatttaaagaaagattacttttaatttcgattttttgttgttgttgagatggagtttcgctcttgttgcccaggctggagtgcaatggcatgatcttggctcactgcaacctctgcttcccaggttccagcgattctcctgcctcagcctcctgagtagctgggattacaggtgcgtgccaccgtgcctggctatttttgtatttttagtagagacggggtttctccatgttggtcaggctggtctggaactccctacttcaggtgatctgcccaccttggcctcccaaagtgctgggattacaggcatgagccattgcgcccggccttaatccaccacccgcccttttttttttttaaataagttgtttggacaagttcctctgagctacaaaatcgtaaacaatagtgatatcagttttgaaataaaactgaggatttctacctagaataaaatacacttgaagctgcagaacttagcctgccaaccaaatagttttgcactgattatgaaaaaagcatcattctttttcatgtgtagcaattgaatttacttatgtatctgccaaatcgcatataagcataaacatttagttttcaattctcatatcctttcaatttatttgtcattaaaaatgtatttttattgtcaattcccatttaaattaaattgtgcatgtgtgtgaagtgtgtattcaaatgaaggtgatatagtatattgtggtagtagaaggatactgaggcttgggatgaagagtttaatgtgtaatctagactaccacatttcttctgatgaaaacagtcccacatctatcctaaaccatcaggcactttcagatttcttctttctttcctatgtgaggctcagcagaagtgtagtgatgatagaagtaagaacgggcagaactaaatgcagggagtgttaacaatacaggcatacttattgtcttacacctcaccgtgctttgcagatagtgcgttttttacaaactgaaggttggtggtaaccaggcatgaagcaagtctcttggtaacatttttttccaacaacatgtgctcaccttgtgtctctgtatcacattttggtaattcttccaatatttcaagctttttcattattattatacctgttatggcgatctgtcatccttgagttttgatgttactattgtaattgtgttgggttaccataaaccgtacccatatgacagtgaacttaatcaataactcttgtgttttctgactgctgcactgactggctgttcccctatctctctccctctccttgagcctccctattccctaagacataaaaatattgaaatcaggtcaattaataactctacaccggcctataagtgttcaaatgaaaggaagagttgcatgtctgtcactttcaatcaaaagccagaaatgattacgcttagtgaggaaggcatgtcagaaactcagacaggccgaaaactgggcctcttgcaccaaatagccaagttgtgaatgctaaggaagagttcttggaggatattaaaagtgctactccagtgaacacatgaatgacaagaaaatgaaacagccttattgctgatatggagaaagtttgagtggtctggatagacgatggatagaagatccaagcagccataatgttcccttaagccaaagtctaatccagagcaaggccctaactcaattctatgaaggctgagacagatgaggaagctgcagaacaaaagttgaaaggtggcagagattggcttatgaggtttaaggaaagaaaccatctccagaacataaacatgcaaggtgaagcaggacgtgctgatggaaaagctgcagcaagctatctagaagatctagctaagacaattggtgaaggtggttacactaaacaacagattttcaatgtagatgaaatagccttctatcggaggaagatgccatcttggactttcacagctagagagaagtcagtgcttggtttcaaagcttcaaaggacatgctgacttttttgttaggggccaatgcagctggtgactaggttgaagccactgtttatttaccatttggaacattgtagagcccttaagagttatgctaaacctattctgcctgtgcttcataaatggaacaagaaagcctggatgacagcacatctgtttacagaatgatttactgaatattttaagcccactgttgagacctacttctcagaaacaaagatttctttcaaaatattactgcagatttacaatgcacctggtcacccaagagctctgatggtgatatagaagaagattaatgttattttcatgcctgtgaagacaatattcattctgcagcccatggatcaaggagtaactttgccttttgagcattattatttaagaaatacatttcataaaattatttggctatggatagtgattctactggatctgggcaaagtaaattgaaaacgtttctggaaaggagtcaccttccagatgccattaaggacatttgagatttatgggaggtggtccaaatatcgatattattaggagtttggaagaagttgattccaacccttatggatgacttggaggagttcaagactgcagtggaggaagaaactgcagatatggtggaaatagcaagagaacttgaattagaagtggagcctgaagatgggattgaattgctgcaatctcctgataaaacttgaatggatgtggagttgcttcatatggattagcaaagaaagtgttcacttgagatggaatctactcctggtgaagatgccttaggtgctgttgaaatgacaacagagtatttagaatattaaacaaacttagttgataaagcaggagcttgagacaattgactccaattttgaaagttctactgtgggtaaattgcatgctacagagaagtcttccatgaaaggaagagtcaatcaatgcagaaaacttcattgttgtcttattttcagaaattgccacaaccacccgaaccttcagaaaccaccatcctgatcagtcagcagccatcaacattgaggcaaagccctccaccagcaaaatgattttgacttgctgaaggctcaaatgatcattagcatttttagcaataaagtatttttaaattaaggtacatgtggctgggtgcagtggctcatgcctgtaatcccagcactttgggaggccgaggtgggcggatcacaaggtcaggagatcgagaccatcctggctaacacgctgaaaccctgtctctactaaaaatacaaaaaattagccaggcctggtggcaggcgcctgtagtcccagctactcagaaggctgaggcaagagaatggcgtgaacctgggaggcggaggttgcagtgagcagagattgtgccactgtactccagcctgggtgacagagcgagactccatctcaaaaaaaaaaaaaaaaaggtatgtacattttttaaaagacataatgctattatacacttaatagactatagtacagtataattataacttttatattcactgggaaatgaaatcttttgtgtaacctgatttattgcaatattcactttattgtagtggtctggaattgaacccacaatatcttggagggatgtctgcagcataattcacattctaccatatctgaaatcagaacgtgtcttacagttgacaggacgtgtcttagatctgatgaaatatagttattagtgggctggacagcaggaatcttactgcttgttgattgagtaactgtgatgatgcctgtttcagcttggaatctccaccatctctagtatattgccttacacacacacagtagattctcaaatatttgtcaccgaaggcaattattgataaaatatacatgaataatactgaattattaataactttagagaatagtgttagctaatttaattagttagaatggaggactgtttgtctaggttaggttaatagtctcatttgaatacttttgaatacatttatgtggtatcaacttatggcctctgctttgatcagtgaattaaataaacccattaaaatgtttcccagttccctttaatttgaaagtcttagagatattacttttgggccttcagagcattcccaggtatgatgattcctgagaagtcagctgatttctaggatcacctgacagtgagaagatacctgggggtctacttaggatggagatgactcctagggttgtttagttagccttcaaaaaaaaaacaaaaacaaacaaacaaaaacaaaacaccttttgagtgcctctcatgtgcactgggatacagtggtgagcaagacaggtgaggtctgcgttctggtgaatgttggcatgatgtatgcaaacacaccagtgcgatgctcaccattcagtaggtgtgccataggtgttagtttctttgttccagatagagtttctaagctgaaaatagcagggaaaccagcttctccccatctgcattctcaactggacttcaatcccatggtactgttttcttgtggcaagacttttgctttggtactctagaaaaagacatgtgcctgctacttatgagagcctggcgggaagaagctgctgcagacatctgtacacattaaaatctaagaaaatgctcccaatcctttaagaaaaccattacttggctcactgcaagctaattgcatttgttcagtcattgtgaaaatggatgcagattgggataagctaagaaataccctactattaaatcacaaaatagagccacttcttcaggagacaccatggcctgagatgaggctttctccaagaagtgggaaattgcttggtaaatttctcttttctgcttaagtaactcttttaattaatttttactgacctactcctcctttgacataaagggagtgggcatataaagaattgggctttgctggcagtaccttccagagtcaaaaagtgaagataagggagatggatttgttctttcaatttgaaacagagctttggtgtgttaggatctgcacctttgttaattagccacaatggacacaatgttattttattttcttatttctgcaatcatctgataagagcttacttttgaaataaaatgttatgatgcaataacaatcacattttaatggaaagaagtacacaacattaagataaaaatacttgagatatctctatttaaaggagaggggttaaaacatgtatctatgattcatagtctgaccttgaaaagttagccaccttgttagcctcatggatactctattgtgaaaagattgcaaaagtccttcggctaaaaccttgttcaaagtttgcccatatataaaaatagatattataatttaaaactgatgatagttttgtactattgaccaaatgagacacacagcactgaagtttatggactttataattatttatgcttttcagagttttaatgattcagtaaagggtgaggacagtctctccaaatcacagcaggcctaacaattctccttcctgggtagccaagtccatctgtttttaaactgggagggagctgctgacactttattaagctgttgttttgcttaaattgcagttatctaaagtgacacttcccctccagtcctgctttccaaagtgtagcaaccgtaacatacacaaacatacgtggctgcccctccagttgattaatatacagagtcaatatttttgctttattttaaagcatcacagcatgtggctgtgtttcttggatatttactttttctacctctcttttctctttttttcctttcactcctgacataagagtggatacactgaatattctacttctagcaagaggaagtcctgtttgctgtttgtgtaaacacttatgctgattacaacctccagaatccttagacatattcatcgttgcaggtctcaaaatgatacagaacaatggacttctagactcagtgacttacctccttagtgaagaaatcttttcctgaaatttcagcttcattatttttcttctgactgcggttttcctgcatgtcagtttacgttgatctggtctgtgaacctgcacctctcttctgcagagatgccttgctgatccatgtggatggacatttcatgcgcaaacagaggtgctttaagtgccgtggtctggctgagccaccgcatctaaacagcatctgctaggaatagttttcaaaggaatcatcagattctagagatggagcctcagttgcatgctcttgatacttatgtgcatgttttttatttacagatttcttttttttttctttttttttttttgagatggaatctcactgtgtcacccaggctggagttcagtggcgtgatcttggctcattgcaacctccacctcccgggttcaggcgattctcctgtctcagcctcctgagtagctgggattacaggggcatatgaccacacccggctgatttttgtatttgtagtagagacaaggtttcaccatgttggtcaggctggtctcgaactcctgacctcagttgatccacctgcctcagcctcccaaaatgttgggattacaagatttcttcagttaactttcagccattgtttgccgaagaaaaatgaaagacataaaataaaatgaggataagtacaatggtcttagaagaatcagagaagataaacactttgcattccaaatgtttggaatcttcccttctctcactccctcgagtttcgttatttccttttcatttacttactggtcaaagcccacagtcactgtgctggtggcagagaacctgacttagatggttttccatcttcaggtaagaggattaacaggaaagatgtgtggacagagttctggggacttgggtgtgtgagaggtaggacttggcagtccagggaagaacctggaaaatctcatggagcctgagaagcagactttcaagagaaggaaactcctgcagcatggtgttaaatcctccaagtgtgtttgcagatgtagaagtacgtgtgagtgagatactagaattaaatcatgcaaaagagcaggcaaattgtccacggaagaaaccagggcaccagcaaagtgggaagccaaaaaatgagcacacccttattcctagttattgtgaagccaaaataatccttaggtattgtacttcagaattacattgcaaaaatttatttttgcctgtaataatgcattctacactagcctagctcctgcattttagaaaggcacagtcccctagatgtgtggacatcaaggatgatatactttgcatgctcaggctccaatggcaagaagattcttcttacatcctgtttctaggaactcttcccacacttcctatcctcccaggcctctctttcagaaggtgtggggttaatagacaagagagagggcagggaattagagaggaggcaatcttgccctccacatttcctcttttgacctagccccacagactttctgaaatgatcccaaccaggttacccacaggacaagtcttagtaagagctaaaaggtagttcttgtgcctcccctgttgaacatcaagttgctactcttagctttggctgaaactccattcatcaggataaatgtagacttcaaggcttgctatataaatataatgggagacagcaggttggtataaaaggctttccaccaaagtacacattatggaatcagattctatcctgttttataaaaataaactgtctagacaaaaagaggggaaaagaaaagctagattctagagatcttggttaaacctagggacttaactatttttttttcatcaggtttgatttattgaaggtcagggcaaaaactgaccttaaaggtcagctagttctatcccatcatttcgcaagtggggacagtgtgcccctgtctcaggttagtacttttatagaacattaggacagtgaggttagtaccttgctaaggatcatcgagctggccaattgcagaggtgggtctaggaccaggtcccctgattagcagccctgtggttttttttttttcattgcaacatatttccaatgtccccagaagtgaaatgaaaaccatgggttatcttacctgcccaggctcttcacagaggttacctaaatggggatcagagtggggagggtaatgaattgggaaacctaagaaagaattgcagagcaaacccatcagccactccctaattacctctttctgtaaatcctctccaggagcctacatctacaactcagctggggcttaatgtgactatatttgataactttaaagttctcaatgctttaatacctgtctaaatttgatgactttaaagttctcaatactttaatatctgtctaaatttgattaatttggggctatctgttctagttggattttttaaaaaattcagatattgtctgaaccattgtgttatgccttgtcttccccatccttctttttttcctcttaggttctatgttttcaaactcagaaaccacgcagaaacccacagatctttgcaaccccacaggttagaaaatctcttgtgaaccctcaccaccagggccctgggtctgatacacacagctgtgtagagtcttagcggaacagtcacttgggcttacacagagacctaacagttttacagactctggccccagggatcctggcatggtgggagttcgacctgtacattcccctaagaagagggctgaatccagggagccaagcaaccttgttccacaggccctacttctatggcacctcacaagttaagattcactggcttgaaattcctgcccgccagtgcctcaggctggagactgcctgagatgaatgagttccagggggaaggggtggccaccatttttgtggttaggtcagctcagccattctagcctgctggctctggggagcctaggtggtcctgatgtggaggaatcccccacaatgcagcacagctgctgtgccagattgtggccagactgcttctttaagtgggacaccaatccatccctcctcactgggtggggcctccctgtgggaatttcagcaagtccagccagggttatatggacagaactctgatatctccttgggatggagttcctgggaggaggggtggttgaggtctgtgcagttcagttgactcagcctttccagcctgctggctgttgagagtccaggtggtctaaacatgaaagagttctccacaatgcagcacacttgctctaccaataatcagccagactgcttctttaagtgggttcccgatcccgtccctcctgactgagtgtgacctccaagtaagagtctccagatacctcctacagaagtgtctaagcccgcaacaggtcagtcccaccctgggatggagctccaagagaaaggagcaggctgctgtctttactgtttcacagtcttcactggtgatacctccaggtaaaggaaaactgaggcaactagggtctggagtgattccccagcaaaccacagcagccctacagaagagtggcttgactattaaaagaaaaacaaacagaaaacaacaacaacatcaaaaaagaccccacaaaaaccccattcaaaggtcagcatctttaaaaatctaaggcagataagcccacaaagataagaaagaatcaacacaaaaatgctgaaaactcaaaagccagaatggctcttctccaaatgactgcaacacctctccagcaagggcacagaactgggctgaggctgagatggctgaattgataggattaggattcagaaggtgggtaattgtgtaattcactgagctaaaggatcatgttgtaacctaatgcaaagaagttaagaatcatgacaggagctgataatcagaatagccagtttagagagaacataactgacctgatggagctgaaaaacacaagaaattcacaatgcaattacaagtaccaatagcaaaacagaccaagtggggaaaagatctcagagcttgaagactatctttctgaaataagatacacagacaagaatagagaacaaagaatgaaaagaaatgaacaacacctccgagaaatatgggactatgtaaaaagactgaacctatgatcgattggggtacctgaaagagatgggagaatgggccaagttggaaaacatacttcaggatatcatccaggagaacttctccaatctagcaagacaggccaacactcaaattcaggaaatgcagacaacccccgtaagatactccacaagaagatgaaccccaagacacataatcatcagatactccaaggtcaaaatgaaagaaaaatgttaagggaagctagagagaaagaccaggtcacttacaaagggaaacccatcagactaacagtggacctctcagtggaaaccctacaaaccagaaaagattgggggctaaatttcatatctggccaaactaagcttcttaagggaaggagaaataagattcttttcagacaagcaaatgttgagagaattcatcaccaccaggccggccttgcaagagctcctgaaggaagcactaaataatggaaagaaaaaactgttaccagccactacaaaaacacactgaagtacacagacaagggacactatgaagcaaccaaataaacaagtctgcaaaacaacaagctagcatcatgatgacaggatcaaattcacacataacactacaaaccttaaatgtaaatgggctaaatgccccaattaaaagacacagaatggaaagctgcataaagagtcaagacctataggtacgctgtctttaggagacccatctcacgtgcaaagacacacagaggctcaaaataaagagataaaggaaaacttaccaagcaaatgaaaaacagaaaaaagcagggattacaatcctagtttctgaaaaaacagactttaaaccaacaaaaattaaaaaaaatacaaagaagggcattacataatggcaaaaggttcaattcaacaagaagagctaactatcctaaatatatatgcacccaacacaggagcaccagattcataaagcaatatcttagagacctacaaagagacttagactcccacacaataatagtgggagactttaacaccccactgacaatattagacagattattgagacagaaaattaacaaagatattcaggacctgaactcagctctggatcaagcagacctgatagatatctacagaactctccaccccaaaacaacagagtatacattcttctcatcaccacatggcacttactgtaaaactgatcacataattagaaataaaacaatcctcagcaaatgcaaaagaactgaaatcataacaaacagtttcacagaccacagtgcaatcaaattagaactcaagactaagaaattcactcaaagcctcacaactacatggaaattgaacaacttgctcctgcatgactcttgggtaaataatgaaattaaggcagaaatcaagaaattatttgaaaccaatgagaacagagacaatgctccgtaatatctgggatgcaggtaaatcagtgttaagaggcaaatttatggcactaaatgcccacatcaaaaggctaggaagatctcaaattaacctaacaacacaactaaaagaactagagaaccaagagcaaacaaacctcaaagctagcagaagacaagaaataaccaagatcagagcagaactgaaggagatagacatgaaaaccccttaaaaaatcaatgaatctgggagctgctttttttggaaaaaaaaaaaaatagaccactagctagactaataaagaagaaaagagagaagaatcaaacagacacagtcagaaatgataaaggcaatatcactactaatgccacagaaatacagacaaccatcagagaatactgtaaatacctctgtgcgtataaactagaaaaccaagaagaaactggtaaattcctgaacacatacaccctcccaacactgaaccatgaagaaaatggacccctgaatagaccaataacaagttctgaaattaaggtagtaataaatagcttaccaaccaaaaaaagcccagaaccagacagattcacagctgaattatatcagaggaaaaaagaagaactggtaccatttctactgaaactattccaaaaattggaaaaggagggactcattcctaactcattctatgagggcagcctcatcctgacaccaaaacctggcagagatacaacaaagaaagaaaaagtcaggccaatatccctgataaacactgatgcaaaaatcttcaataaaatactggcaagccaaatccagcagcacataaaaaagcttatctaccacgatcaggttggcttcatccctggatgcaaggttgcttcaacatatgcaaatcaataaatgtgattcatcacatgaacagaactaaagacaaaaccacgattatcttaatagaagcagaaaaggccttcaataaaattcaacatcctttcatgataaaagctctcaataaattaggtattgaaggaacatacctcaaaataataaaggccatatatgacaagcccacagccaatatcatactgaatggacaaaagctggaagcattccccttgaaaactggcacaagacaaggatgccctctctcacttctcctattcaacatagtactggaagtcatggccagggcaatcaggcaagagaaagaaataaagcatattcaaataggaagagaggaagtcaaattgtctttgtttgtagatgacataatcctatttttagaaaatcccattgtctcagctccaaagcttcttaagctgataagcaagccttcaagatacaaaatcaatgctcaaaaattgctagcattcctatacaccaacaacagacaagcagagagccaaatcatgaataaattcccattcaccatagctacaaaaacaataaaataactaggaatacagctaacaagggaaacaaataacctcttctaggagaaatataaaccactgctcaaggaaattagagaggacacaaacaatggaaaaccatttcatgcacatagatgggaagaatcaatattgtgaaaatgcccatactgctcaaagtaatttatagattcaatgctattcttattaaacttgatattcttcatagaattagaagaaactattttaaaattcatgtggaacagcaacaacaaaaaattcatatagccaagacaatcctaagcaaaaagaacaaagctggaggcatcatactacccaactttaaactatactacaaggctacaataaccaaaatagcatggtacttgtacaaaaacagacacatagaccaaaggaacagaatagagaactcagaaataagaccacacacctacaaccatctgatctttgacaaacctgacaaaaacaagcaatggggaaaggattctctatttaacaaatggtgctgggagaactggctagccatatgcagaaaattgaaattggaccccttcctcacacatacaaaacttaagatggattagagacttaaatgtaaaacccaaaactataaaaagtctggaagacaacctaggctacatgccattaaggacataggcacaggcaaagatttcttgactaaaatgttgcttttgttgcaattgcttttggcattttatcatttcaaacgagatctaattaaactaaagagtttctgcacagcaaaaacaaaacaaaactatcatcagagtgaacagacaacttacagaacgggagaatttttttttgcaatctatacatctgacaaaggtctaatatccagagtctacaaagaacttaaacaaatgtacaagaaaaaaaaaaccctattaaaactgggcaaaggacatgaacaaacatttctcaaaagaagatattcatgtggctagcaaacataaaaaaaagtcaacataactgatcaatagagaaatgcaaaaatcataatgagataccatcttatgccactcagaagggcaattattaaaagtccagaaacaacagatgctggcaagtttgcagggaaaaaggaacacttttacactgttggtggaagtgtaaattagttcaaccattgtggaagacagtgtgatgatttctcaaagatctaaaggcagaaataccatttgacccagcaatcccattactagttatatacccaaacgaatataaatcattctattataaagatacatgcatgtgtatgtttattgcagcactattcacaatagcaaagacaaggaatcaccccaaatggccatcaatgatagactggtacatatacaccatggaatattatgcagccataaaaagtcaaaaaaaggacaagatcatgtcctttgcaagcacatggatgcagctggaagcttttatcctcagcaaactaacacaggaacagaaaaccaaacactgcatgctctcacttataagtgggaatggaatgaagagaacacatgggcacatgtggggaacaacacatgctggggcctgtcagagatgggggtagtgggaaggagatcatcaggaagaatagctaagggatgctgggcttaatacctaggtgatgggttgataggtgaaacaaaccatcatggcacacgtatacctatgtaagaaacccacacatcctgaacatgtacccctgaacttaaaagttgaaggaaaaatagaaaaagagctgtaaacgtattagattctgcagaactgggccctacattttcattcattgagagtctcaaaggtctgttgaaaaaacctaaaattaacaaaggttttatttgggaaaacgagttaatttttgtcagaactaatgatgttaaagaaaaaaagctatcatttcaagcaaaggggaatggttttctgtttcagaattttctagtagttctctccctcttggagtacaatcaagtgtcataatattgttaattgctctgtgttcttctgggtgctgcagtatattgagtaaaatgttagaatgttatggagtagatgaccagtttacttgactacaaatgagaagatgaacaagctgctttttgtctttactaactaaccatttgttctaggagctcccattttcaggttattttaatgagtccgtcaaaccagggggtatggtggatggaataggcagctgcaccttgtgcctgggaaacatagcacttttggaacatggatctccacactcaaaaatacttccatgttatatgggaatcatgggatttctgaactgaccaaatcctcagattatatctgatcctctctcattttaaagccaagatgatgaaggtgtagagtgactgcaagtcctacatagaccatgaatccagagcccatttcctgacttctgttctgcttattgaagagagggctgttgcctttagtctggggacatgaagacacccagatcagtgttttcctatctccagactaaatggaagtgctagtgagctaacaaaatgccagtgggcttttgagatgtctggagacagtttttatttgttacatctgggcaagatgctactggcatctagtaggtagaggacaaggatgccaataaacatcctaaccagcgcaggaaagcctcgaattatccagccagaaggccagtagtgcccaagttgagaaaccctgctccaggggagttgttgaactttggagttgacaagacttggattcaaaccctgatctgctggttgctggctttctgggtaggctaatcgatctctttatatttcagttcctcctctataaaatgggcttcaccatagcaccaattgcataggattgtcacgagggttaaataagatgctgcacataagacacggggatttgcacacagctggtgctaaatcagtgttacttactgatgttattaaaacctgcagaaatgaattttcatgctattttggttactgtagccctgtagtatagtttgaagtcaagtagcataatgccttcagctttgttgtttttgcttaagattgccttgcctattcaggctctttttttttttattccatatgaattttaaaatagtttttttctagctctgtaaagaatgtcattggtagtttaatagtaatagcattgaatctataaatcactttaggcagtgcaaccattttaatgattttgaattttcctatctatgaacacagaatatttttccatttgtttgtgtcatctctgatttctttgagcagtgttttgtagttctccttgtcaagatctttcacctcattggttagctgtattcctaggtattttattctttttgtggcaattgtgaatgggactgagttcctgatttagctcttggcttgactgttgttgttgtataaaaatgttagtggtctttgtacattgattttgtatcctgagagtttgctgaagttatttatcagcttaaggagcttgtgagctgaggtgatgggattttctagaaataggcttaggttgtctgcagacagggatagtttgagtctccctctttttattcggatggcctttatttctttctcttatctgattgctctggccatgacttacaatactatgttgaataggagtggtgagagagggcatccttgtcttgtgccagttttcaaggggaatgcttccagcttttgcccattcagtatgatgttggccatgggtttgtcataaatggctattattttgaggtatgttcattcaatacctagtttattaagagtttttaacatgaaggggtgttgagttttattgaaagccttttctgcatctagtgagataatcatgtggcttttgtctttagttctgtttatgtgataacatttattgatttgcacatgttgagccaaccttgcatcccagtgataaagcctacttgagcacggtgagtaagcttttgatgtgctactggattcggtttgccagtattttgttgaggatttctgcatcagtgttcatcaaagatactggcctgaagttttctttttttgtgtgtgtctctgccaggttttggtattaggatgatgctgaattcacaaaatgagttagggaggaatccttcctcttcaatttttcagaatagttttagcaggaatggtaccagctcttcattgtacatctggtacaattaagctgtgaatccgtccagtcctgggctttcttttttttttttttttttggttggtaggctatttattactgattcaatttcagagtttgttattggtcttttcagggattcattttcttcctgactcagtcttgggagggtgtatgtttccaggaattgatccattttgtctagattttttagtttgtgtcatagagatgttcataatattctctgatgattgtatttctgtgggatcattggtagtatcccctttgtcatttctaattgtgtgtatttggattctctctcttattagtctagctagcagtctgtctatttttgttaatttttctcaaaaaaccaacttctggatttgttgatcttttgaatggtttttccatatctcaatctccttcaattcagctctgattttggttatttcttatcttctgctagctttggggtttatttgctcttggttctctagttcttttagttgtgatgttaggctgttaaatcgagatctttctaactttcagatttggaaatttagtgctataaatttccttcataatcctgccttagctgtgtcccagagattctggtatgttatatctttgttctcattagtttcaaatacttcctgatttttgccttaatttcattatttacccaaaagtcatttaggagctagttgttcagtttccatgtaattgtatggtttcagtgaaattcttagtcttgatttctaatttgattgagtaatgttctgagagagtggttgttattatttcagttcttttgcatttgccaaggagtgttgtgtgtttgattatgtggttgattttagagtatgtgccatgtggcaatgagaagaatgtatagtctgttatttttgggtggagagttctgtagatgtctatcaggtccatttgatccagtcctgagttcaggtcctgaatatctttgttaattttctgtctcaatgacctgtctaaactgtcagtggggtgttgaagtctctcactattattgtgtgggagtctaagtctctttgaacatctctaagagcttgctttgagtgttcctgtgttaggtgcatatatctttaagacagttaggtcttcttgttgaattgaatcctttaccattatgtaatgcccttctttgttttttttgatctttgttggtttaaattctgttttgtctaaaattaggattgcaaccactgcatttttctgttttccatctacttggtagatatttctctatccctttattttgagcctatgtgagtcattgcatgtaacatgggtctcttgaagatagcataccaatgagtattggttctttattcagcttgtcattctgtgccttttaactgggggcatttaacctgtttacattcaaggttagtattgctatgtgtggatttgatcctgtcatcatgatgttaactggttattatgcagactttatttgtgtggttgctttatagtcactggtctgtgtacttcggtgtgttttagtagtgactagcaatagtctttcctttccagagtcagtgcctccttcaggagctcttgtaagacaggtctgatggtaatgaattccctcagcatttgcttgtctgaaaaatattttatttcttctttgcttatgaaacttaatttggtcagatatgaaattctgagttggaaattcttttctttaagaatgttgaatattggcctccaatttcttctggcttgtagcgtttctgctgagatgtctgttgttaggctgatgggcttccctttgtaggtgacctgacctttctctctagctgcctttaacacttttcctttcattttgacctgggagaatctgatgattatgtgtcttggggatgatctcctgaggtaacttactggggttctctacatttcataaatttgaatgttggcctctctggctaaattggggaagttctcccggatgatatcctaaaatatgttttccaagttgcttacactctccccatccttttcagggacaccaatgagtcatagatttggtctctttacgtaatcctatatttctcagatgttttgtttgttccttttcattcttttttctctattcttgtcctactgtctttttttcagaaaaccagccttcaatccctgagattctttcctctgttttgtctattctgctactaacacttgtgattgcattatgcaattgttgtatttggtttttcagctctatcaggttggttccattcttttccatactggctgttttgtctgttagctcctgtattgttttattgtgattcctagcttccttggattgggtttcaaagtactcttgtatcttaataatttttttcctgtccatattcagaattctacttctgttatttaagccatctcagcccagttcagaacccttgctggagaggtggtgcagttgcttggaagaaagaaggcattctggttttttaaggtttcagagttcttgcattggttctttttcatctctgtgggctgatgtttcttcaatctttaaagttgctaacctctggatggcttttcttttcttttatcctatttgatgaccttgagggtttgattatggtttaaggtgaattcagccactggtttcatttctggaaaagttttaggatccagtgctcagctcctaactcctggactgtgtgctctaactctgaggaatttgtatcaggcctgactttgttctctggcttctcgaggtttgaaattcactgcactggggtggggcaggacgggtagggagaaagtgctgtctgaccactggtcactacactctgatgagtggtgtctgccaaagcatttcatagtgttgcaggaataggatccatttgtgttctcatatgccagcagcagaagcagcaggattgcagagaggtgtactcttgtcagtggtggcagggtgctagtgggtgcctgggtacctgcctctgtgtgggcatttaccacagtggtggaggcatcatggctgagcaaggcagaggggcccccgctagtgactctgtatatattcacgctggtggtggtggtgacacaggggtgaaaggaacaggtctgtgtgtgctctctgtgagccagaggcaggggtggtagctcagggtgggggagggtctgctattctctgtgcctagtttaacttctgcagcagtgttggtgcaagggcagaacactggcaggggcagaacactgtgcctgccaaggctctgactacaatggccatccggcattgggagtggtagcaggccgcactcccactgcagcaatggcagagcagggtgcatgtacacatgcatgctggaggggcaaggaaggtaaaacccacctacccacgcatgcaccagcaaagtgatatggaaggctagtgtgggcctgggaggaggctgcagggtggggagggagggagtgggctggtgtgtggccatgggggctgccctactggagctctccatgggtcaggcatggcccaccagtgcaggagctattatgtggcccccagggcaccctaggttgccctgcaagcaggtacaatgaggctggggtcctgagagaggccagcagacccaggggtgctcaggttggaccaggcccatctgatgggaaagaccgccaggcagagttcaggtctgagagttaccctagggctaaagcctcctatgggagcaagctgaacctagggggagggccatccctggctatgctctgcactagctgctcccacaccaaaccctctgggccccacatcatctggcttgctgttcctaccacttctctaatcagctcttgctgccaactccagtgtccatggtggtcgaggggtttcctcctgctagggttctatgggcccatggagagaggggttgctccttaccagttcagctcacttgcttccctggagtcattgggggccaggaaagagtcccagggcaacgtagccctgtgcagagttctcagcttcctctctcttcagcccagcttctgtggtcttccctccatccactctcagtgccttctctctgaagatctgttaggagtgtgccaatcgtcttggtcccttgtcatggctgttctgcctggctccatctacttggccatcttgtcctctccctgatttcttactatagaaaccttagctcttttttacacttgtttgacagctctcctcttccctctgttatcttttgaactttttcagcttgtctttctattgtcatattcttattttctaggagattatttttgttctcacattgtttcttttaaaattatctcctgtttttgtttcatgcatgtgctgtcctttctcataattctgaagatattatagttgttttttgcttctttttctgtttcttctgcttctgtgcatcgcttgtttcctcagaattgttttactttcttttgacacacagagcctctaattggcttttaaattctcacttttaaatatgcacccaaaattaacagacatttgaggaaagtgtttttatattaaaaaaaaaaagagtagatgaaactacagaacactaaggaaataaattgaagaggacaccaaaaaatggaaagatattccatgttcatggattggaagaatcaatattgttaaaatgtctatatcacctaaaatgatctacagagtcaatgaaatccctattaaaataccaaataaattcttcacagaaataggaaaaaaaatcccaaaatttgtacagaaccacaaaatacctagaataaccaaagctatcctgagaaaaaagaacaaaactggaggaatcacattacctgacttaaaattatactacagatctatagtaaccaaaacagcatggtactggcataaaaacagacatacagaccaatggaatagaatagaaaacccagaaacaaatccacacacctacaatgaactcattttcgacaaaggtgccaagaacatacattaggaaaaagacagtctctgataaatggtgctaggcaaactagatatccatatgaagaaaaatgaaactagacccatatctcttgccatatataaaaatcaaataaaaatggattaaagatttaaattgaggacctcaaactatgaaattactaaaagaaaatactgggaaaactctccaggaattggtctgggcaaaaagttcttgaatactaccccggaaagcacaggcaaccaaagtaaaaatggacaaatgagatcacatcaagttaaaaagcttctgcacagcaaaggaaacaatcaacaaagtgaagagacgacccaaagagtggaacaaaatattttaaaactacctatctgacaagggattaataatcagatgacataaggagctcaaataactctacagaaaaattttaacaattcaaaaatgggcaaaagatttgaatagatatttctcaaaagaaggcaagcaaatggcaaacaagtatatgaaaaggtgctcaacattactccttacagagtgtttttgcatttgcctttgctagtaaccacagagtttcacttctctgagattgttgttattttttgagattcctgcactatttgaatagtgtacatttagacggcacacctatactatgtacaaaattactgttttgatttctcaaacttgagaccttaaaattatttttcacccagatccacaggcagagataagcctcctttacactttcttgggtggttaggacgatatttctccttactttttgtgctgattattaagctacgggccctcaactttaacccctccttccatactctgtcttataatgccaggactgtgattctacaaaacacatttcccctttgccatgtggctgttttttagcttttgccaatagggggctccacatgagggtggaagacaggagagagaaaggacttgccacttcctgtttgtttgctattcctgaagcatcaccctggtgatggtccaccggtccaacaatggcaatggttccagttcttggcttctttacaccatcagtgccagcctcatttcatcccatctccagagacagcagtaccagctgagcagcactccctccttagaggtctgggtcttagttctgtggggaccctcctgcaaggttctcatgactacacacctgggcaagaacacataggtccagaccaataattctgtggtagacagcttctaaaatggccccaaatcatctctgtctctgggtatttatgctcttgtataattcctaccccttgagtgtggctagacctaacaaaaaaataaaatatggcacaactgatgggatgccacttctgagattacgttacagaaagactctggcttccatcttgccctctcttggctcttgcttgctctgagggaaaccggctgccatgttgcaagatgccttatggagaggcccagtggtgagaagccgagggaaggtcctggccaatacctagaaatgaattgaggccctcaggccaacagcttgtgaggaactgaatcctgccaacagccccatgagtaggcttggaagtagattcactcccattggacacctgagtgcagccttgtgagagactctgagtctgatggcccagctaagccacacgaggatgcttcacccacagaaactgtgagataattaatgtttgtggtttaaaactgtgaagttttggaataatttttacacagccctagataacaatacaacctcatttctgataacagaataacttttgaatggaggcagaagatcttcaaaggtgctgactttatgtaaggctggcagttccagctctctctagctcccaccagtctaagacctcgtcacctctcccagcacaggcaataaaaccctggccctgagctgttggggcttttgtctaacatctgtatctccagggcatcatctccctgcaagctccctcctagtttctggcagtacctgaaaatttcccttacttttgaacttaattgtgtacttttaaacattttgtaatatttatccagaatttatctgtgctttaggaagaagtggatgtccccatcagctcagttctccccattgccagaaatccaaaggcaagcagaagtctctggacagtcatacacaggataattaaacccagggagtctctgtattttaattctcagtattgaaatggattgatttttaccagttgttaaaacacagactctagttcataatataaatgatctccctgggtgaatgccactagggcaatcgggtagcttaatttcttcctccctgatgacttacaacttggaacagacaggaaagtagggtatcaaaacaaatacttgaaggccaaagataaaaaatgttaataattagtaacagctagaagcaaagttaattctcagtgggcccataatgccagttatttaatgcaaattaacaaatggcattttaatgtaaaggacttgaaagctaatattctaattttccaagtaagatcaataattcaacaaccaataatgtgttcgaggaaggaataactttatttcagagataagtgaaatgctaagtgaagtttatatttgtggatccaaaattagactaaattagagttaggtgccacatgcattggaaagaaggcctcataaaaatgaaaagtgtgagcattagttgaacacagagtgataaaattttgtgatataatactagataatgagatgctcttatttctttgacagattatgaaggataattctgaattaaagtggtgttgttttgaattcttggatcttgtgttttaaataaaagtttagtcaatgaatcatgaaacagcattccaacttctgaccttgggttgctctggatgaataattttgacttgaagtataaaaacacacccctatattcagactgtaaaattgccgtggccgggaatgacatgattttagcatctagtttatacaaggtgctaaataagaccacatgaagttgataacttccatttgtgtaggaccttgcagtggacaaacacattctcatactttctctcctttgatccttaaaacaagcctgcatggtagatgctcttagcctcatttgataggtgagggaattgagaaattattatttacccgagtcataaaatttgcaaatgaaggattcctccctggacctttgcagtgtgttgctgtatgtggagtgagttttaaaaaattatttgtacaaatttatggggtacatgtgcaattttcccacatgcatagattgtgtagtggtgaagccagggcttttatggtaccaattacccgaataacatacattgtacccgttcactaatttatcatcctctcccctcccaccttctcacccttccaagtttccaggatctattattccactccgtatgtccacgtgaacacattttttagcacctatttaggagtaagaacatgggatatttgtctttttgtgcttggtgccaaataatgacctccagttccaaccatgttgctgcagaagacatgattccattcttttttatggcttttcactccatgatgtgtatttaccatattttctttaatcattcatctgttgatggccttagattgattccatgtctttgctcttgtgactagcattgcaataaacacacgagtgcaggtatctttttaaatataatgatttcttttcttttgggtagatacccagtagtgagattgctgggtcgaatggtagtccaacttttagttctttgagaaacctccgcactgttttccatagaggtgtactaacttacattcccaccagcagtgtatatgagtgacttctactgccatagacactctcttcctcctgctgtgtctgtgcatttgctttccataatggctggcaaagacagatgagtggccccctttatcaccttcactgctgtcaagtgtgtttggtcatgcagctgccctagcacttgtttatagtcttttgttttgaatgtgctatttatcagacagaattcaaatgcaacttcaatcatggtgaactacaaataccttcttttgtggcacattctctaccctcctcccaccctggtattattttcttactctagttaaaaaaagaaaaactttgtattgaagtacaccatgcatacagaaaaactctatgcaataaataaattttcagcaatgcccatatattcagggcccaaagcaagaaaaaagttactagccctccagaaacacccctgtatccctctatcccctctgttaccacccactgtaaaggtaatggttggtctaatttctaatggcctacattagtttggcctatttacatagtttatataaatgaaatctttcctgtctggcttttcttgttcaacaatatgtttgagagactcatccatgtcatagaatgtagttgtacaatgtttgttctcaatgctgcataatattccattgtgtggactctgttattttattaaaatattattacatataaaatataatatacaagacagtagacatatattctagaataatcatatttatccattttatagttgatggacatttgggtggtctcttaaatttggctattattagtagtcctgatctgaacattttagtataggttttttttatgaacttaaatatgtagttttttgtggtaagaatgtctcaatttttgtatcctgacattcttccactggcagaaacaaaaatatataaagagcataatttttccttgatatattttatgttaatgttaataacctaaatcacattttctgtaaagttaagattgctagtaacaaacatgcctcatttgtttaaaatttgtaacaattcagactgaaactcaacagatgtctcttatttagcaaacattttctttaaaaataacatcaattaatattttaatataaagcatattgaccgggcaaggtagctcacgcctgtaatcccagcactttgggaggcagaggtaggtggatcacctgaggtcaggagttggaggccaacctggtcaatatggtgaaacccgtctctactaaaaatacaaaagttaaccaggtgtggtggtgcacacctgtaatcctagctactcaggaggctgaggcaagagaatcgcttgaacctgggagatggaggttgcagtgagcccagattgtgccactgcactccagcctgggtgacacagcgagactccatctcaaaaaaaaaaaaaatatatatatatatctatatatatatgtataatatatatgggatatatttcaaatacaagatctggtcatgaaatgctttagaaactacatttacatatatagctcgcaagataattacaaatggatcttctttaaatatgaaaactaggtatccaaggaagcatcctttataataaacttgttagcagacctgaattggccatacttaaaaatggaaaatttcttttttttttttttttgtttttgagatgcagtctcactctgtcgcccaggctggagtgcagtggcacaatctcggctcatgacaacctccatctcccaggttcaagtgattctgcctcagcctcccaagtagctgggattacaggcatgcaccaccatgcctggctagtttttgtatttttagtagagacagggtttcgccatgttggccaggctgctctcgaactcctgacctcaggtgatctgcctgcctcggcctcccaaagtgctgggatcacaggcgtgagccaccgtgcctggccaaaaacatggacaatttcttttacaagttatgctatattctgttcatttcaaatcatctggatttagatgtggccctggtattaatctagcttgcacagaacactgatctgaacgtagaactttccccccaattaatcaggaagaacacagtagtaaaataatcctcatcatatttaaacattcatggagcagtttgtacaggaagcatggcgttggctggaaaggactgtggtcggggaaagtatgtgtgaccagggcatgcacgtcctctctcctccctccacccagtgcttctgcagacttataaacatggatttataaatatgtcattccaaacccttttctcactaagcatcccctccccctttgtttattatctagccctgtggcttaggagagttctgttttgactaagccagcgtctcttttcaaaataattctctcaccgcctcctaaaaataaagtttttccctctgctacacaatgaattggaagagtcgggtgccctggaagcccaggagaagagcattagcacagctctgggaggtggggggatagaggagagagggcctcaagatgcttccaggggaggtgagctttagatggagaacctgagcatgagtactggtgccgtgggggtggggtttgggttagcctgtgtgtttgggtcagaatgagctgtgtgtgggaaagagcagggtcctttccacgagccagtggccctctcctcacagcagtgtacatgagcgttggttgcccacgtagctgacattgttggagaggtggctctgtgagatatatatttagtaaaattaatcatattctgataaactcttgtgtataatccaggaatgcaaatcttagaggtggcacagcagtggggagaaggccagctgtgagtccacactcttaagtatgaaacctgggttgtcacatcctagatgtgtggtcctgggaagggtaggtatattcttcttcacctgtaaaatgggaataaaaataacacacatctcagagaatcatcctgaaggtgatactgaaattacacatgcaaaaagctgtgcacagtgcctggtccacagttagcacccagcaaattggtaattaagtaattaatcaattaacggtaaaactcttaattgcactttattaagtttttctctggaagttcttcagagaattgattattgagaacaacactgatgtccctcagtcagttcaggctatcacagaataccagactggatgacttcaataacaaacatttctttctcatagttctgggggctggaaatctaagatcagggtgccagcatggttaggttctggtgagaaccttcttcctggttatgtcctcctctggccttctttggtgtgggtggagagagagagagacagatggagagagagaaagagagagagagagagagagagagagagatcctgtgtctttttgtaaggttatgtcatctcaccttcatgacttaatctaaccctaattgcctcccaaagggcccacctccaaatattatcccattggagactctggtttcaacatagaaatttagcggcgggggaagggcaggggtggggggtacggggcggacacaaatattctgtctgtagcaaacaacaacatttataaagtacattaaaattcataaaatgctttcatataccttctttgagccacataataatctaggcagaaaatagggatgaggaaattgaggttcagaaatgttaaatgtttcagccaacaaagctcacagatggaatccatctccggctggaatagaaccatgctgcagatgctcagactggaagtttacagtcaggccccagagatgccctttcgaactttacctttcaaattccccacagaagagcatgaggcaaactgggctcatacccgactgcctcctgagcgtgtcagaagatcaaaggagatagcgtgtggagaatctctttctgtagtgtagtatgccatgtttttagctgtttttagttgtagtcctcttttgtttagtagcagcttagcctaccaatgtgatatagctcaggcagcaatttttaactccttaaagttttgccaagaaaatttgaagtttcatatgaaaaggcagacattattaatagcatgtcaacaaatatttggaatgagtggtttttctggcttcccgtgccagaaaaaccacttgcttgatttcaccgtaacaagtgtttaccatagtgatttcacgtcatgtcattttaggttgggatcaggattggtccaattaaaacttcacatcttaaaggaaggtttcctttctttcccgaattactgatgaagaaagtttttgtgtgtgcatgcatgcaaggatatgcacatatgtgtgcaaacgtgtggtggagcatgggaataaagagattatagaagaagagaggtgtttcaccttttcagatattctgtgctcgatcttttcagctctctggtctttctgatacaagcttcctctttccatcaaatgcttgacgggaagcggaatcttctggattcagaataccggctgttccctccctgtgccctgatatgtctgaaggacacacttttctgtggctttacctgttcttctcaaaggggtaaaatagctgagccctcctttccacgtcactgaattctaaccttcctgccaatggaagctccaatcctgcctgctctgtctcaccccctctatccaccagagctagaaaggattttttctccctaatgaagcctgtgatttcctagtggcccttagctgccagcataggcagtctgcattgtatttttgtttatttgttattttagagacagagtcttgttctgtcatccaggctgcagtgcaacagtgcaatcagaactcctgggctcaagtgatcctcctgccttagcctcctgagtagctaggactacagtcatgcaccatcatgcccagctaattacaaatatatatattttatagagtcagggtctcactaagtcacccaggctggtctggaactcctggcttcaagtgatcctcccaccttggcctcccaaagaacttggattataggtgtgagccatgacagctgatctgcattgtgttttagataataatagtcacatcagccagcttgtattgaggacttgcactgtgccaagctccgtcctacgtgccttactcaaaatagctcatttaactctgaaaataagtagacaacaatttgtagacggcaaagggactattttttgctccctagcaatattttgaaggatactgagacttagtatgttttttggggtggtggatggggagtgatgaggtgaaccttggatgtgataggaacagaataatttaccaggagaaaaccttccacatctttgccatcccttttcctccccaattttttattataactttgttcaaatgtacacaaatatgggataatagtatgataaataactaaattttaagcctaacaatttttagtattacacatgtggaatttatacatatatgtatgttataaatgtgttttttgtggaatcattcaaaaatgaattgctgatatcatcacattcatccctagaaagtacagcatgcatcagcctcttacgtggccatgatactgttatcacacctaggaaggttaacaataaaattggatgtggattgtctttgtctcttcatccctatttgatcagtaaaaaggcaatagaacaaaacaattaaaatttggatttctaacaatctagcattccacattctttggttacctgtacatggtatagtcaatctttctatttgcttggaaagcacttgctactttgatgtgggagagatactatcttttactactttgaaaatttgatttcaccttcttaatatggtaaatatggacatgcccatggcatgattgggaaaattaagaatgaacattatagattaaaaatttcagcccctatagattggaactctagattttttccccccaaaaatccagttaaatttagggataatcaataattcatagatacaacctctaaccaaggatttaacagtttaatgaacaagaaaccatacattagtccaaaatttaacagttaatagataagacttcaacctccatttctaagagtgtgcaccagctggggattcagttacatttgtgagctggtgacagattatggctttttccatttacgaaagaaatcactgtttttgctgactctagaaaaaatataacttttaaaatattgaagaaataggccaggtgcagtggctcatgcctgtgatcccagcacttcgggaggccaaggcaggcggatcacctgaggttgggagttcgagactagcctgaccaacatggagaaacctcatctctactaaaaatacaaaattagccgggcatggtggcacatgcctgtaatgccagttacttgggaggctgaggcaggagaatcgcttgaacctgggaggtgaaggttgcagtgagccgagatcactccattgcactccagcctgggcaacaagggcgaaacaccatctcaaaaaaaaaaaaaaaaaaaaattgaagaaataatgtgtaaactttgcttcatatttatttcctccaagccaactagtatctcaagacttttcatactggatatagttgtctaaacacagtatattatcttccaagtattcaattatacttgattaatttgcctgaaaagtttttactgtgaatggcatttgtgattaatctgacaataatgattgatattagcttgtctctgacagagacaatgtttgcttcttcctttccaggtttggaactatgcttggtcgttcctagtacttgtggaaagaggtaagtgttatatgataccttagaagtgaatatccaagtaaccaagaaatattcaatgatcatattgtgctgacctgggaggaaatcctagtttttgcttttgataagagcctgtacttttcatggtggcatgaattgttccagaaagacataatggtccttgctaagaagcttctgaaacttctgaattttagggaataccaactgtgtgtcaagtgtacttaaaatatctgatatgacacctttctaaaatgaaatcaagcttttatgagttgaattgtgtccctgccaaaagtatgttaaagtcctaacccccagaaccttagaatgtgaccttatttggagatagtgtcttttcagatcaagttaaaataagtcgttagggagggccttaatccagtatgactggtttctttataaaaaggggaaatttagacacagaaatcaggatggtgtttctctaggctaaggaacacaaagagttccagcaaaccacccaagactaagggagaggcctagaacagattcttcctcacagcctcggaagggaccaaccctgccaacgctttgatctcggacttctagcttccagaactgtgagccaatttccattgtttaagcctcgcagttgtggtgctttgttatggcagccctagcaaatgaacacctaggtcaactacttgagctcatgtatgcggatgtgaggtgtaatagtttctcagtggctgggttgcaactaatattagtatacaatttcctctggggaattaagtagtgttctttatatttacttaagatgctctttttcttatattcctacaaagtaaaattattttattttaaagcgaatcatgtggatatccacatacgtaactaattagctattcattgaccattgaaatattagtaatgatgatatcattctccttggggtagggaagctgaatgttttagtctgctccacatctccttatctgggaaacattcctgagctactgtctagtccctactctgtccttgtggtatggttaaaactatgtattctagctggtcccagggatagccaataaaacttatccatgtctctggtcactgtaattggttcagcaatgagaatatgacccaaggtagaccaatcagagggtttcccaggcattttgctggcatgatcaggaaaaatgttatttttatcaataattaaaagtcctaaggtcagtgtagacttctcttttaggatgggatcctcactgaaaatgatggagccaagctgggtcaggaggaatagggtcagtcagaattcttaatccatgaatcaaacccttcctgaaatcagaaacattccttggactttccacttatacaaaccaataacttttctcttgtgctttaagccactttgagttgggcacttacaaggaaaagtgttttaatgcatctgtgatgtgtaatctttacttattttttgcccctttacatcctctgaaagccttggattattccagtgtttggagcacagtacattaagagttggttgaattttttatcctacattgtcagaataaaattaatttccaaattaaacaaaatgacactgtgatgattttccctgtaatatgcaatgatgtcaagcactattcactattgtcactgtggcaggtgagttttccagtgatggccacatgtgtagtatgtacatatatcccctcatatgctcttatttcaatgcaattgtctatcttcccacagagaagtcatgtctgtgtttcttccctatgaatgtgagacttgtgactgctccaatcatgagaaaatggtggaagtgacagtacgtgaccaaagcttaaagggtacaacctccctttatatggacctggccctctctcagatgtttacccttggaaccacttgcagctctgtgaggacaaacaaggagaagtccacatgaagaggagctgggctcctagactccactagcatcacctaccagacaagtgagtgaacaagccttcagatcacttctgcccccagtgttcaaggtcctagatatcgcggagcagagatgagtcatggtcacaccgcgttatttcagtttctaaacccctgaatatatgagcataacaaatagctttacatcactgttagggtaatttttatgcagccatcctgagatcattcatttgtaatgtgttgtgctggctagactgaactacgtttctcagaattcccttatgttttggtcagggcaggcctcaggagagagtcttatgggagatttggaaggtggaagtaaagtggcagcttttttgtattttttaagctcacatgcatggttgctggcccattggctggctggcattaggcagcaacctgaccggcagcctgtagctctcctgcactagtgtgtgcttagctccctgacaaaggcctaaacttcttcaggactcctgcatcataaaccttagaagcaataaaaactgatatgttatgagatccagtttgtcctctgggtaccaccttgcccatgcccctcttctagtttataaccatcttctcttcctgcttgcctgccttgtagacctcaagcatcgtcatcagactccaggacaacagctttgcagatgccacttaaccagctcctgcaactatgtaaggtcaaatccctgtttataggagagagaggcagaggaacatggccaaacagaagctcactgattgtcctccctgtaggaacaccaaattgaacaactatccacacagaaagcacctttataagaaccaaaaaatcaggtgattactgtaaaaggcactaaagagggtaggaaaggcagtcttaaattgctgattccaccccttccccatcctccagcagtgaccttgtggcatggagaatctgtgcatttagggtaagaagagtgtagtgatcatgagactgtgttggaatactcagtgcttccctgtcagagagcaacatctggaagaattcaactggtgcccatgaaagaaacatttagaccagctcaaaccagagggtaatagcccaatctgaattcagggaagactcatcactgtgggctaaagtgctctcgggtcgtaaataaacttgaaacacagtctaggccacaaggactgcaattgctgggcaagtcctgctgctgtgctgggctcaaagccagtggacctgggggacacgtgagccagtgagatagtgaatggagtgcttacatcacctttaatccaattccagccatcacagctcaaaactccagaagagattccttccctccacttgaggagagaaaagagaaaagaggattttgtcttgaaacttggataccagctcatccacagtaggatagggtacaaggtacagtaggatagagtcctgaggtccctattccaggacctggctcctgggtgacatctctggacacactctgggccagaagagaatccactgccttgaaggacaggacccagtcttggcaggatttatcacctgctaactgaagagcccttgcgccctgaataaccagtggcaatactcaggtactatgtcgaggaccttggttgagttgctgagacttgctcacttcaggtgagactcagcatattcccagttggggtggctatggggtgaaactcttgcttgactgagaaaaggagagggaaaaatacagggggctctgtcttgcaccttaggtaccagctcggctacagtggtttagatcaccaagtgggttcttggggtccctgattccaggacttgacttttggataacatttctggacatgcctggggccaatggggaggccactgccctgaagggtgagccccaagccaggcagcattcaccacaagttgatttaagagcccttgggccttacaggaacatcagtgataatctggcaatactccctgtggcttgtggtggtggtggctacagggtgaggctcctctgcctttggaaagtggagggaagaaggactgcatcttgtgttttgggtgccagctcagctgcagtacgatagaatgccacgtagacttctaaagattctgactcaagacactggctcctggatggcatctctggatctacccagccctgggggatctagctgccctgaaaagaacgacacaagcctagctggctttgccacctgctgattgtagagacctagggccttgagtgaacataggaggtagccaggcaatggataccacaggccttgggtgagacccagtaccatgctgtcttcagatgtgaaccagtgcagtctcagtggtggtggccatgggggtgcttgtgtcatccctcccccagccccaggcagttcagcacagaaagagagagactctgtttgtttgggagaaagtaaggggagagaacaagagtctctgcctggtaatccagagaattcttccagatcttatccaagtcaccaagacagcacctctatgagtctgcaagagccacagcattactgggtgtgggatgcctcctaatgcaaatagggctgcaatgaccaaaaaatagatttaaacacccaagtcacttcaaatatctggaatgccttcccaagaaggacaggtacgaataagcccagactgcaaagactacaataaatacttaactcttcaatgtccagacaccagtgaacacccacaagtatcaagactatccaggaaaacatgacctcaccaaatgaactaaatacttgccaggaaccaatctcagagagacagatatctgacctttcaaacagagaatttaaaatagttgttttgaggaaacgcaaagaaattcaagacagcacagggaaggaattcggaattctattacattaaatttaataaagagatggaaataattaagaagaatcaaggagaaattctggagttgagaagtgcaattgcaacactgaagactgcatcacaggctttcagaagtggaattgatcaagtagaagaaaaactgagtaagcttgaaggcaggctacttgaaaatacacagtcagagaagacaaaagaaaagagaatttaaaaaataaagcatgccaacaagatttagaaaataggctcaaaggggcaaatctgagttttggcctgaaagaggaggtacagagagagataggggtagaaactttattcaaagggataataacggagaactccccaaacttagagaaagatatcaatattcaagtgcaaggcggttatagaacaccaagcaggtttaacccaaagaagactcactcaagacacttaataatcaaactcccggaggtcaaggataaaggatcctaaaagcatcaagggaaaagaaataaataacatataatttagctctaatatgtctggtagcagacttttcagtggaaacctgacaggccaggagagagtgacacaacacatttaaagtgctgaaggaaaaaacctttaaccttagaatagcatatctggcaaaaaaaaaaaaaaaaaaaaatccctcaaacgtgaaggagaaataaagactttcccagacaaacaaaagctgaggtatttcatcaacaccagacctgtcctacaaaaaatgctatggagagttcttcaattagaaagaaaagaacattaatgagcaacatgaaatcatctgaaggtgtaaaactcactggtaatagtaagtacacagaaaaacacagaatattctaacattgtaattggggtgtgtaaaccacttatatcttgagtagaaagactcaaagaactgataaaaaataataactaccacaacttttcaagacatagtacaataagatataaatagaaacaacaaaaagttaaaaagtggagggacaaagttaaagtgtagagtttttattagttttctccttgcttgtttgttagtttctttgcttatgaggtcagtgttaaattgtcctcagcttaaaataatgagttataagatattatttgtaagcattatggtaacttcaaataaaaaatagacaacagatataccaaaaataaaagcaaggaattaaaacataccaccaggaaaaatcaccttcactaaaaggaaggatagaaggaagagaagaccacaaaacaaccagaaaacaacaaaatggcaggaataagtccttacttatcaataataacactaaatgtgaaaggactaaactctccaatcaaaatacaaggtagctgaatggattaaaaaaaaaagacccaatgatctattgcctacaagaagcacacttcacctataaagacacaaatagactgaaaataaagggatgaaaaagatattccatgctaatggaaaccaagaaaatagttaaagaggagtagctatatttataacagatgaaatagatttcaagggaaaaaaagacaaagaaggtcattatacagtaataaaggagtcaattcagctagtggatgtaacaactataaatatatatatgtactcagcactgaagcactcagatatataaagcaaatattattagaactaaggagataaaccccaataaaataataactggagacttcaacaccctttcagcattggattgatcctccagacagaaaatcaacaaagaaacattagacttaatctgcactatagaccaaatgaacctaataggtatttacagaacatttcatccaacggttgcagtatacactttcttctcctcaccacttggatcattcacaaggttaggccactgtattagtccattttcacactgctgataaaggcataactgagactaggcaatttacaaaagagtttattggacttacatttccacatggctagggaggcctgtcaatcatggtggaaggcaaggaggagcaagtcacatcttacatggatggaagcaagcaaagagagagcttgtgcagaaaaactcctgcttttaaaaccgtcagatctcatgagacctattcactatcatgagaacagcactggaaagacctacctccataattcaatgatctcccactgggtccttcccacaacacgtgggaattatgggagctacaagatgagatttgggtggggacacagagcaaaatcatatcattccactcttggaccctcccaaatctcatatcttcacatttcaaaacgaatcatgcccttccaacagtccctcaaagtcttaactcatttcagcattaactcaaaagtccacagtacaaagtctcatccaagacaaggcatgttctttctgcatgtgagcctgtaaaatcaaaagcaaattagttacttcctagacacaatgtgggtataggcattgggtaaatactgccattccaaatgagagaaatcagccaaaacaaagggattacaggccctattcaagtccaaaatccagtgaggcagtcaaatcttaaagcttcaaaatgatctcctttgactccatgtctcatatctagttcacactgatgcaagaggtaggttcccatggtcttgggcagctccgcccctgtggctctgcaggatacacctccctcccagctgctttcatgggctggtgttgagtgtctgtggcttttccaggcaaacagtgcaagctgttagtggatctaccattctggggtctggaggatggtggtcctcttctcacagctccactaagcagtgccccagtagagactctgcgtggggactctgaccccacatttcccttccacattgccctagcagagtttatccatgagggcctcacccctgcagcaaacttctccctgggcatccaggcatttccatacatcttctgaaatttaggcagaggttcccaaaccccaagttttggcttctgtgcacttgcaggctcaacaccacatggaagctgccaaggcttggggcttgcactctctgaagccatggcccaagctgtacgttggcccctttcagccatggctggagcaactaggacacagggcagcaagtccctaggctgcacaaagctcggggaccctgggcccagcccacgaaaccattttcttctaggcctctgagcctgtgatgggaggggctgatgtaaagacctctgacatgccctggagacattttccccattgtcttagggattaacacgtggctcctgttacttatgcaaatttctgcagcctgcttgaatttctcagaaaatgggtttttcatttctatcacattgtcaagctgcaaatcttctgaacttttatgctctgcttcccttataaaactgaatgctgttaacagcacccaagtcacctcttgaacgctttgctgcttagaaatttcttctgcaagataccctaaatcatctctctcaagttcaaagttccacagatttctagggcaggagcaaaatgctgccagtctctttgctaaaacataataagaatcacctttgctccatttcccaacaagttcctcatctcatctgagaccacctcagcctggaccttattgtccacattactatcaggtttttggtcagagccattcaacaagtctctaggaagttccaaactctcccatattttcctctcttcttctgagacctccaaactcttccaacctctgcctgttaccaagttccaaagttgcttccatattttcagttaccttttcagcaatgtcctactctactggtaccaatttagtgtattagcccattttcacactgctgataaagacatacctgatactgggcaatttgcaaaagaaagaggtttattggacttacagttccacatggctgggcatgcctcacaatcatggcagaaggcaaggaggagcaagtcacatcttatgtggatggcagcaggcaaagagagagcatgtacagaaaaactcctggctttaaaaccatcagatctcatgagacccattcactatcatgagaacagaactggaaaggtccacctccataattcaatcatctcccccgggtccctcccacaatacatgggaattatgggagctacaagatgagattttggtggggacacagagccaaaccatatcagccacaaaacaggtcttaaaacattcaaacaaatcaaagttacatcagacatcttctcagacaatggaataaaattgtctgacaattctcagacaatggaataaaactagaaattactaagaaaagaaattttggaaactatacaaacacatggaaattaaacactgtactgctgaatgaccagtatgtcaatgaataaactagaaggaaatcgaaaaaattttcttgaaacaaatgttaatgggaacacaatataccaaaacctatgggataaggcaaaagcagtagtaagaggaaagtttataggtataagcacttacatcaaaaagtagaaatactttaaataatcaacctaataatgcatctttaagaactagaaaagcaagagcaaaccaaacccaaaattagtagaagaaataataaagattaaagcaggaataaatgaaatgaagaaaatacaaaagatcaattaaataaaaagttggttgtgaaaacataaacaaaatggacaaaactttagccagactaagaaaaatggagagaagacccaataaataaaatcagagaagaaaagggagacacttcaactgatactgcagaaactccaggattattagaagctagtatgagcaactatatggcaataaattggaaaacctacaagaagtagataaattcctagacacataaaatctcccaagattaaactatgaagaaatccaaaacgtgaacagaccaataacaaataacaagatttaagctgtaatacaaattctaccagcaaagaaaagcctgggatgtgatggcttcactgctgaattttatcaacatttaaaaaagaactaataagaatcctactcaaactatttcacaaaatagagggaacactttccaactcattctatgaggccagtattaccctgataccaaaaccagaaaaagacacataaaaaaagaaaactacagaccaatatccccaatgaacattgatgcaaaaatcctctacaaaatactagcaaactgagttcaacaacacatttaaaagatcattcatcatgaccaagtggggtttattccaaggaagcaaggatggttcaacatatgcaaatcaatgtgatacatcatatcaacagaatgaaggacaaaaaccatataattatttcaattgatcctgaaaaaacatttcataaaatttaacacccctttgcaataaaaaaccctgtgagggaacatgtgtcaacacagtaaaggccatatatgaccacatatgacagacccacagctagtatcatattaaatggggaagaactgaaagccttttccctaagatctggagcatgacaaggatgaccactttcaccactgttatttgacatagtactggaaatccaaactagagtgattagataagagaaagaaataaagggcatccaaattggaaaggaaggagtgaaattatccttgtttgcagatgatatgacacttggaaaaacttaaagactccaccaaaaactgttagaactgataaaacaaatttggtaaaatttcaggatacaaaatcaacatacaaaaatcagtagtatttttatatgccaacagcaaacggtctgagaaagaaatcaagaaagtaatctcatttataccatttataatagctacaaataaaacacttgaaaattaccttaaagaaagatgtgaaagatctctacaataaaaagtataaaacattgatgaaaggaattgaagaggacacaaaaaaagaaagatattctacattcatgaattggaagaatcaatattgttaaaatgtccatactgcctgaagcaatctacagattcaatgtaatccctttaaaaataccccattcttcacagaaatagaaaaaacaattctaaaattcctaaaatttatattgaacacaaaagacccagaataatcaaagctatcctgagaaaaaaagaacaaaactggaggaatcacattacctgactccaaattatactacaaaatctgtagtaaccaaaacagcatggtcctagcataaaaacaaacacatataccaatgaaacagaatagagcacccagaaataaatgcataaatctacaatgaactcatttttgacaaaggtgccaagaacataccttggggaaaagacaatcttttcaataaatggtgctgggaaaactgtatatccatatgcagaagaatgaaactagacccctgtctctcaccatatataaaaatcaaatcaaaatggattaaagacttaaatctaagacctcacaccatgaaactattgaaagaaaactctcggccaggcgcggtggctcacgcctgtaatcccagcactttgggaggccgaggtgggcggatcatgaggtcaggagatcgagaccatcctggctaacatggtgaaaccccgtctctactaaaaatacaaaaaaattagcctggcgtggtggcagacgcctgtagtcctagccactcaggaggctgaggcaggagaatggagtgaacccaggaggcagagcttgcagtgagccgagattgtgccactgaactccagcctgggcgacagagcgagactccgtctcaaaaacaaaaaaaaaaagaaaactctcccagacattgaacaaggcaaacatttcttgagtaatatcccataagcccaggcaatcaaaggaaaaaatggacaaatgaggatcatatcaagttaaaaggcttctgcacagcaaacagcaaagtgaagagacaacccacagaataggggaaaatgtttgcaaactatccacccgacaaggaattaataaccagaatacataagaagttcaaataacgctataggaaaaaagctaataatctaatttaaaaatagtcaaaggatctaaataggcatttctcaaaagaagacatataaatggcaaacagatatatgaaaaggtactaaacatcactgatcattaagaaatgcaaatcaaactacaatgaaatatcatctcacctcggttaaaatggctttttatctaaaagataggcaataacaaatgctggcaagaatgtggagacaagtgaacccttgtgcagtgttggtgggactgttaattactattaagactacttactaccaattagttacttttgtgggtacaacaactatggagaacagtttgaaggttcctgaaaaaactaaaaattgagtactatatgatccagcaatcccactgctgggtatatacccaaaggtaagaaaatcagtatattaaagagatttctgcactcctctgttaagcagcactgctcaaaatagccaagatttggaagcaatctaaatgtccatcagcagacaaatggataaaaaaaaatgtggtacatatacacaatgggagtactattcagtcataaaaaagaatgagatcctgttatttgcaacaacatggatggaactggggattgttatgttgtgaaatatgccaggcacagaactttgcatgttttcacttctttgtgggagctaaaaattaaagcagttgactcatggaggtagagtagaacaatggctaccagaagtggagcacgaaaagggggacgattaatgtgtacagagatatagttagatagaatgaataagacctagtatttgataacacagcagggtgactacagtcagcaataatttattgtacatttaaaaataactaaaaaagtataactggatttttataacacaaagaaaggataaatgtttgaggtgatggatactccacttaccctaatgtgattattatgcattgtatgcctgtatcaaaatatctcatgaccccataactacatacacctgctatggtacccaagaaaatgaaaaattttaaaaaccctctttatattatatataatgcctaatatataatattcaattataaactatactgcaatatataatttaaaatatatatgacaagatactatatataatatgtaacatataatagatgtcctcacatacatattatatacatgtatgtatgcctatatatctcctggattctgcttctttgattgaaccctgattgatacacatagtaattggatacacatagtattcaataaatggctttcttctgtttcattttattcccctcttgtcactcaatattgcacagccacttgcttctggttattgctcacagcatcctgcacttgttccctgtttacatgagtactgccgcaatcctcactaatttgcaagtctgaaagcattttgatgacgtaaataacctttgaatgcaagctgtgtctgagaaaaactttcccacgtatataagaatagatttatatccacattggactcaaatatccacatgaagataaaggcttccttcttcctcatttcctggatgactcttcatccaactttttaggtcaaggcgtcttagtctgctcaggctgctattacaaaatactataaactcgtgacttaatcaacagatgtttatttcttaccttttggaagccagaagtctagcaccagggtgccagcatggtcagtgtctgttgagggccctcttcctggctttcagagagctgccttcttactgcgtcctcgcatgatggagacagcgttctggtctcctattattaggacactaagcccatcatgggagccctaccctcatgacctcatctaaacctaattacctcccaaagatccccctccaaatgtcatcacaatagggtttaaggcttcattatatgagtttaaggggggcacaaacattcagtttataacacaaggtaagaaataaatccaattaacctataaagacttctgaaggatttaagtatttgctcattgttggctgtgtttggaagttggctgctgaaaggtatactctgcacacgagacatatattgggagggtatacttgaggaagatggtctccagttcctctacagtgttaaggctgatgtatgtcactcctacaccagtatttaattgtacattgtccccatcatatgctaattgtgaagcttcctcagcaaagagaaaaccactgcagccagggacactggtggagaatatgctgatgactcagagtgaagcatggcaactcttagaaaaatgacaactgtattctctgctagtggaggtaccctcaaagagaaatgtcctgtacagcccaatatattacattgttagtcttagatgtagtgagatgcatcaacatactaggaatataaagcaagtaggtagaattactgttttcactccaggatcaggaaaggcatctaagcatcaaacacactgggataaattgcatatggcagtatgtctcctggctctgagcgatgccccttcctcctgctcacacaaacctccttggccacagttggttggactgagtattgacacgtgacccatgttgggccaggtagattctttttcctgcgaacttggattttcatcaagaaatactatgtgttacttaaatggcaacatatcaacatggcatatcagaattatttcaggtgcaagtggctgacatccagtctaagtggcttaaacagaagaggatttattgactccatgactgaaaagtctaaaggtaaaactcagtggaggtttagattgatccaaagatctaaaaattgcaacaggactaaggttctttttccatttcccgactgtttcttctgggttggtgcaatctcagattgtggtgtcaagaaggctacagaagctccagtttacaactcccaagtttgagtccaaggggaagagcgcatccttcattacccaaagtcctagcaagagtctctttgcatctcactgactctgattgaatcacatgtctatagccgaaccactccccataggtgggaaaatgtgatgctctgacggtcgctcacccagagctagaggtaaaagtcaagcatttagaaaaatagggaaagcaaaagtaagagacaatctcaagctaccaaatgttcattacctcaatgtctggagctatgaggcagccatgttccaccatgcagacagagaagcagaggaagcactggctaaaacgagagaaaagactggcatagacattatagggtccaaggggtaggtttccctcagccccttgaaggttcactgaaaaattaattcacaaaagaaagatgaataggagaaaaggcatatatattgacttaatgtgtgtacacgggagccttgagaatgaggccccctttaggagaagctgtccatttttatgtttaggtacaacaaagtatggacagccatgtagaaatacgattggagaaaaagggtgtgacctaatgctaatagactgagtgggaaaacccaacaaagcctatctgactagattcttcttggcctctctgagcactgttccttccttctggggatggggcaggaccttctctgcaataggcatcttatgatctacagtcagacaaggtaggtccgataattttctttatggccagtttttattcagaacgggaaagggaaagctagcgtaataattttaggttttatggatagctttcaggaaaggaggctgtggtttctacggtttgccttggggaagagggattctagtttccatggctagcctcaggggaaattgagtctgagagacagggtggtaggaggtcagagaaaaactttgcttctaaggccttcatgttggggtattgttttctgagccccaaagccatgcagaaggaacaagagacagaaaacagaaagggcacttcccaggtccctgtggttttacagggcatgtttccatctcttcctgaggcttgatgcaaacctgttcttaggatctgtgagactcctctgtggcttgatagtatgtcctcttttcctctctttttcttttgttcctctgaaggtaacttgcattggtttctattactcacaggcagtgacattaatcctaggagcccatcagagtctttacatagctctgtgacgggaaaacaaatggagcatatcccaggcctaggaattgtctgtcttggaaggaaaagtaacaaaactgtgtgccagaatgtgagagagaatgctggacatttgttgtttttcccatcaacatcttctccttgccccatggggtatcattgctccacaattctccagggatgcattgtgggtaaaactgactccatgtttaagccaatcagcacgttccatacatctgccagagtgactgacttcctaatggtcagatgatatgaatcctgcccatgacagctaagaagtttcagttctcatgcttttgttggaactgtcagtgaaacatattctcctttcctgttggtatgaatgtgaaaggatcacgggactggaattatggaagatagtttgtcaacacatgagtcctgtgcatgaactgaacaccaggaaagcatagttgagaaatttagacaggagctccagcccagggaagtcatttgagccctggatcaagctgtacctgaaactggagctccctctggattctttagttttgtgagttaataaattcttttttcttttcttaatctgatttgagttagagttttgtcacttgcagcagaaggaatcataactaatacagttatgggaagttatgtttgaggaaaggtgtcaggtaatctataagatggagaggctgaactataaacagagcaggtcctaaaactccagtaggcacgctttctccttttcttgaaatcataaaacactacaattgacatggcatatatcacacattgccttgaactgcaattacagttcttgtatggtaggtacaaatttcacaaccataaaactccggtgtgcagaaatgtaactttctttattgttttataattgagcttaatttagctcacaaaccctcatttctgctaatggtagggaacttaatcttgccaattccaggcaattctgtcagtcctggtttaaagctctgtatctttcaattactttaggattccaagttcctctactcctttctttttccctaaggtgatctgtgttctagcaaacatggcaaggaggcaaatgtctggtctgggagttgacctcgggccagtgggcaacaggctgtaattggtccaggagagctgggcactcatccttgttggctctgtccccacccagttcttagctcagcttctgcagattcagccatgactttgtctagttcctagtttgggctgcccacatagtccctggccttacatcatggtcacctccctaccaggcacaccagccctcaattctcagctccctttggcattcgaatccaacgtttggggacttctgggtttccacatcctgcaggagtgagggtgttgggaggatgggtcctctcggcatcctgtctgcctgaatcatctctgctcccatttctgcattataggaaccaactgtgatggttaattttatgtggcaacttgattgggccaagggacgtccagatatctcaccaaacattctttctccacagtctgtgagggtgtttccggaagagattagcatctgaattggtggactgagtcaagcagatggccctctccaatgtgggtgcaggccacccaatctgttgcaggcctgagtagaataaaaaggtagaggaagggagggttctttctctgtgtcttcttctgactgcttgaactgggactttgatcttccatcctcagcactcgtggttctcagccttcagacttgaaatggaaatcacagcaccagctctgcgcttctcaggccttgacctataccattgactcctgggtctctagctgtaggtggcatataatgggacttctcagtctccacgattgaatgagtcaatactgtattatctatctatctatctatctatctatctatctatctatctatctatctatctatctatctatctgtcagtcatctctgtgtgtgtatatcccctatctgtttctctggagggcctgcctaatataatacaccaccatatgtggctcaggaggcagcttcctcctggatattcaggaaaatcagttctgctcttggaccctcaagccctcaaacctgctgggtgtgatctcaagggagggtgcaggcctccccctcctctcaccttgcttgcttccctcctgtgagatctgcagctcccacccaggagggctattgtcctcaccatgtgccgtggtttgttgagctctttgctctgggaccctcctggctggctcttgatgtttcttgaaatacaacaaaagatctttttcctctcacctgtctggattttataaatgaaaatcatggtctttaagaccatgcctccaagaccaattaagaccatgtctcaattgccagaaattcactccaaaggtccaagttccagagtttaaatacatgtactggcttcctcattgggtcagctcttccctgctgccacaggcctcagacttgcggttttgctttagtggaggaagcactgcagggcagagacaaggaaaagagttccagagaaggaaagccacttggtactatttcacaacaggatctggctcagtgagccacagctactcctccaaccacagaagcgcctccagtcttgctccccatgtgggatggccattgctgtggggtttgcaggttgcttgacacctttgtggagccaaactccaccagcgctactgagaagtgcagctagtagaaggaactgtcccttccagcttaactatcctttttttaaggccagttggccccaggtggtcattgttcttttagcctctgaaagttggcctcagtgttttatttcagtagcttcttgtcaataaaccaacactgagttccctgcagtgttggcctaggctgtggtggcccctgtgggactcctaactcatcctcagtgctgtgagttgaatggtctgccataaagatgtgttgaaattctagcccctggtggcagtgaatgtgaccttgtttggaaacggtctttgcagatgtgattagttaaggatcaagatgagatcttgctggattagggtgttgcctgaacttaatgactggtgtccttataaaaaaaggagaggacacacagagacccagactcacagggagaaagccacacaatgatggaggcagagctggcagtgaggcatctaccggccaagggacaccagggactgctgggagctgccaggagctggaagaagcagggaggatccttccctggggactttggaggagtgtggctctgctgacactttgactttggacttctgacctccagaactaacagagaataggtttctcttgttttaaacagaaatgtttgcttctttagtgcgactttgttccagcagccctaggaaacactcaggaacctcaatcatgacccatttctctgcactcagtcctaggttcagacactctaaaggcttgagacattgcagggatccagaggctgctaaatagagagtggacccctcctaggtcccctttcctgggctggtgtccccagctgttgtgagtctgggctgctgacagctcagacggctgtcctctttaagaagtttcccctgtggaacaagagctgcctcacccaggaggcttcacagcacccctagtggggtgggcagcccacagtcaatgactggttggcatgggacaaaggctgctctccttgtgcaaatggggtgcagttccttgttcctgagctctctgtggggtcaggctgagggtcctggctaccccctcccttccagtgggtacagtgctccatcctctctgtgcctccgaggcctggctcaggtttggcctctagcgaagctgacctatcaccatcagattggaactccctgagggtagggcctatgtgcttagtggccctctcctttgctgggtaaggtgtggcctaaggcagggattcttaatctttaatgtgcatgtggagagcttatttaaacgcctcttcctgggcctaactccagaagagtctggtcccgagaactggcatttctaatcagctcccaggtgctgctgctgcattttgagacttactggcctaagctctgtggattaatgggatcttgtcgggtcggggcaggcctggtgaccgagaggacaagcacaccagaggtccacagacatttgtttgcatgtgggatttttgaggctgggcagagaatgtaaggagtgtgtgtgcagggttgggagttggtaggagatgaagaatctgttgtggtgttttcaaaggtggattcctgggcccagtcccctggcctgtgtctaagctcttaggagtgaacagttgtgggtagaagcctaaggaattgtttatctcgagatctttttgagatggaggggtcccaaaagccattccattaggcagaagaggcaaagcttgactaagagaagaaaattctcacatgtgtgtgcctgcacctgtcactgcatgtatgtgtgcgcctgcacctgtcactgcatgtatgtgtgcatatgcagtcatgtacatatgtgtgcctgcatacatgcaccagagcacgtgcatgtgtggccccaggcttgctgagtgctttctgctttacttgggcaaggcagagccaccaccagctgcagtggcttcccacacaaaagctgagatagccccaccctgacacacacatgtgagtcgtctctatttgaattcttccctctgttgtgcagcaatctatttttgtatgagagccctagactcatttgtggttcccgaaaatttggggtttgctgtttccagccttcctctcctgcagcgcagccgctgtgcctgtgtttcatctccctctgcctttgccctgccgatgacacagagggaagcttagaattctccctgctttgtggttctattcacctctgtgatcagttgttttgtggctatagttactctactttgcagaaaggggatttgaattctttggattctttgttcacaaacaaaccagtgccagagccactgcctcttcgccgcctgcaaagtgcgctgcgctgcctgccagcagggggcgggggtccatcctcgtttctatcagattcccggacacgctgcaagctccggggtccgtccctgtgtgtgccttcctcttttgtacaagttacaaaggaggggcttaggttcagggtcgacttaatcgcattcctgtccctggcacatccccattagccctctgagatgctgctaccgctaccttttctgtagttttgtccttccttgcagccccctctccatgtccccatcctccattggtacctactcgaacatattcaacaagtgtttgtacctgcgggagatgggaatggagccccacctggacccccttgccaggtggtgaacctgacactctgcagccctgagcgttggctgcagacagctcacagctgcgggggctggggatggtgacggccgctcttgctgaagggagctgccaggctgagactttgcacaccgctgggtgcgggggagtccccaagccagtgcttgtctgatagaggggacaaaaggccagtccccttacctcaaggcgaagtccaagctgggatgcgtcagagctccaggggatctttctagactttctccaaacccttgttctcgctgagctgcagcctcgcactattctgggtccctcccttacctccgttctcctggaagcttcccttagcgcatcacacacacccaaatcccatctcagactgtgtctctggggacttgcatgaagatgggatctgtgtagaatgtgtagacttgtgtgtgtgcacttgtgcccgtgtgtgcttaacacagccccccatggactgtggatgcctactggaatgatatcctgggcacccacactcttcccttaagcaccgtctgtctgggctctatccctggcacgatccattcatccagcccgctgcctcttcctacccatatgtattccagagggtgctaccacatcctatgcagccacttctctagtgacgaccacttaggtggcctcttcctctacatcctcaatgggcatccttgtgcatggacccttggactcatgtctcagaatctccacatggcccctgggagtgggtctgagtgatgggtgtgtgcaaacttagcttcccagagtcctgcagattgcttcccagggtgcactcatagcccaacaacagcacacaagtgtccagttcccccacatcctctcctgcggcagggaggggcctgccttcccctgtgtgctgttctgatgttaatttttcgttctgatatttttctgttcattgctagtgacttttagcatctctgcatgttgggtgttggcacttccccttttgcaaaccatctactaactttttgtaaaagatttattaattttagatgctctgtttattctagacgtgaatccctcgttttatacaatggaaatatcttctctaagcaggctgtctctttccttgttgttggcatcctctttcagcagaaatccttcagagttgctgccttatgctctcatcgttgtatggaggttctgataagacagctcatttctatttcacctgtcttttgctgcagtcctccagccaggactcaggtatgagtccacagggggctgtgttaaaggacaccgaattacagagaccatcttcacacaaaatcatgcttccctttcgtcctgacccataaaccctacttttgctccctggcctctcttctgtgagtgggagtgctttttctagagcttttccatttttcaggcagagagaccccagatgggccatctcactaaaccctggaggtgccgagactcacttgagccgcacagaaaacacatgtcagcatgccacgcgcatcccctgccgtagtgtaagcaacaggagtctaattcctccatagcctctctggagaggaacttttcatctttgtgcgtctcaataggtccccagtcatgcattgctgctcttatagcgagcaaacaatattccagaaaatgcccagatgcatacacagtgccgagtagcacaagaaggaaagttttatttagtggggtcctctggggacacctggtgggctctctctgagggttggatgcatgggtagttgactctttgaggaagagaattgaggggctggccgtggtttcccacatgaatgactatgaggggtctgcagactgggatcccagggtggtgggcacggacagcggggctggcattgctggcaagactggctcccagcctgacaattgcctaggcctggcttcagcaagctgcttctgcaaagggccagagagtaaatattttgggttttgctggccatatggtctctgctgcagctatccaactctgccaatgtagtatacaagcaggaatgggcactgtgtgaatgaatgaacgtgctgggtttcaataaagctttatttacaaaaacaggccagatttgatctgtgggtcactgttggctaactgccagcctatgctgttgcatgtgcctttagtggagccgtgagctgatattttcacaaggttccaaagtttcacggttgctttggattggcttgaataaggctaaaatcaccaaaactaagatgtagcggatttctgataatgttttcactatactaattatatctgatatataatggagtgcccagggcaagatttaaaatggggagttgtatgggcagctcaccaggatgaaagcagtttgtgtttaagcttgctctgacccacggccccagggccggctctaccgccaccaactcaaataagacttttattacgggttagtcagagcacgtagaacaaatccgcattatcttcagtgccctgaatcaacaccagtgtaaatgagttagaggaatgtcctggagccgaggtcagcgacttttggcccataggtcgaatgcagaacactgcctgtttttgtgagtaaagttgtgttggaacacagctattttagtccactcgtgtgtgctgcaagaacaaaataacggggactaggtaatgtataaagaatagaaatgtatttctcaccgttctggaggctggggagtccaagatgaacgtgcctgcatctggtgtctggtgatggacttctcgttgagtgtcccgtgttgcaaggtggaagggcaagaggaacaaaggccgtgtcctcacccggctccccttgcagaagtgtaagctggccaaatgctgccggaagcttcttttatgagggtcttaatcccacctaagggggaggagcccccatagcctaatcatctcttaaaggcctcacctctgaattccttcacattggcaacacctgaattttggaggagacacgtttgaatcgtagcaaccactgtggccagtcatttgcacgttgcctatgactgcccttgcaggagaatctcagagctgagcaattgcagcagagactgtaaggcccttgaaacctaaaatgtttgctgcctggccctctacagaaacattggatgatccctgcactagagccccaaaggggaaaagaattattaagatctgctgtctctcctttctgatagtgtggtgtagatttagctgtgactgagaatctgaaataacagtgactggtactgcccctgctgcactcagcactgtctgtggtgaacaccctctgtgcctctcattttgctgccaccactgtggggctgccacaggctctggtgctctggttgcctgcaactgtggggtggcggcttaccaatgcactaggtagagagccaggcagctatcctgcccatcgctcacatccacggctcccatcttttcttcctgtgggtgctgacttgtggagggagatgttttcctcagcatgcatgaatcagttaggattcaactcagctgtgaataatggaaaacccaaataacaatgatgtaagcaagatggaatttaaaaaaacaactcatagtggtctggaaactccacaattatcagagattcgactgtttctacttctctctctctctctttttgtatccttagcatatgttttctcttcccaagtttgcctcatggtagcaagatggttgctgaagatcagtagtcacacttctatcccaggtggtatttattttcagggccacagaaaggaggagggtacataagggaagtagggcacatctataaacagaggcagttccatttaaataacttttctggaagctccatcaacaacttctgcttatatcttgttatagattaaattgtgtctgccccacctgacctaaaaaagatatgttgagtcctaaatccccagtatctcagaatgtgaccttatttggaaatagggtcattgtagatgtaattagttaagacgaggtcatcctggtgtcaagtgggctcctggtgcaatatgactggtgtcctcgtaagaagatggcatgtgaggacagagacacagaggaagaacaccacatgacaagggaggctgagattggaatgatgcagctacaagccaagggactcaacgactgtctgcaaactgcagaaggctagcaagtgtcaaggaaggatttcctcatgggtttcacaggcagcacagccctgccatcaccttgatcttggacttctaggctccagaactgtgagacaatacagttcggttgttttaagtcactgcattgttatggcagccccaggaatatatacataactcaatggctggaggtacctgaaagggagactgagaaatgtcatttttctggcccattttcactgtagggaggaattagaggacagtcctggggatggcagtgcagcctctgctacagatgctctggaatgaggcttcagtggaaacttctcatctcttgagcgcttctccaaagcacctttcccctgaaaaacaggtggggatggtagattttactgtggtgctcttccatttggaaaagagtttagttttttcttctactaatttgtgatctctagcttcatttccagaccttcctgatatccaccctgttccataaaagaaacattgctgacctcataattcttatggcttaagttcatggccctcagatgactcttgatggtgtgggtgggagacagcttctgtccctgactctggcagccagccttggccactgtcttagctccctgtggacaagtccagactacctgaggccattgaccttcctgctatacctctttttctctttgagcatgtaattcctttaaggattaaaccttaggagatttccaaaatgtcgctaagctctgcactcctaagttgtgaggacagcctctgtaagtagggcatctaaggtcatggagaggacctttttgcagttaatcttgactaaaatggcaaatagaatgtgatgtcatcaacctgttgacatgaaattaaggctttcttctgttcttcagtcccattttctcttttaggtggctgtctctggtcctgcatgtctgatctcccgctaattcctgtcccaccaccttctcgttccagtttgctgccctaggaccctcttggtttctgattattatggcaagtccaaggagatgtagaaattcaaagtgtggttgtttgaatgaaggcaggagttggattacccacattagaatgagatctgagtgatacctgcaaaggaaagtctgcagctcctaagctgtcccttcattgctcagattcattggaacatttattctctttgattcaatatgaaaaaatgataatttagtgctaacatgatactccaaataactgggtaccaacctgttagttttatggaattcttcatgagagtaacggttgtttgtttttgtttttttttgagacagtctcgctctgttgcccaggcggagtgcagtggcacgatctcggctcactgcaacctccaccacccaggttcaagtgattcttgtgccgcagcctcctgagtagctgggattacaggcgtgcatcaccatgcctggctgatttttgcattcttagtagagattgggtttcaccctgttggccaggctggtcttgaactcctggcctcaagggatcccctacgttggcctcccaaagtgcctggaatacaggcctgagccactacgcccagccataacttttttttttttttttttttttaacccataggttttgctggtctcaggcatacttatatgtcttagtctgttcaggatgctataacaaaatatcatagatggggttgcttttaagcaacagaactttacttcttacagttttagaggctgagaaagtccaagatcaaagcactggcaggttcaatgtctggctagggcctgtttcctggtttgtagacggtaccttctttctgcctcccacgtgttccacatggcggaaggactgagggatcgctatcaatcctctttcataagggcattaatcccattcatgagggctcccaatcacctcccaaagtccccaccttttaataccattaccttgggggtgaagatttcagcatattaattttgggggacacaaacatttggaccatagcattacatccaccttttctaaatgcattaaaactggtaagggatattagcatgtcaggactctttctttccaaagccatgttgttgttttcttccacttttcgaggttgttgcaaactgaattgctagtgattcttctcccgagcccatctcagcaaagaaaataaatttatccataaaacaacaacccaggccactgggtcggcctcgtagcaaccaccacgggggaaaggaagaacccagggcttcctaaggtagttctcggcataaccaccagggggcactgctaaagtgctgtctcctggtcctgggcctcctaagttggggatgatgtggtctgctgtgcaatgagcatctcggtcacaccttgagtgcaattagattaaaatgtgtcaattattggctgtgttccaggtgtttttctgtgttatctcatttaattccattatttgcctgtgtgggaggtatttcgaatttcactttacaggttggcaactaaagtttttgctcatgagctatctcacatcctaggtgcttgtaagaggtgaaaccagttttttgtttttgtttttgtttttgagacggagtttcgctcttttacccaggttggagtgaagtggcgtgatctcggctcactgcgatctccacccctcggggtcaagtgattctcctgcctcggcctcccaagtagctgggattacaggtgcctgctaccacgcccagctattttttttttttttttttttttgagacggactcttgctctgtcacccaggctggagtgcagtggcgcaatcttggctcactgcaagctccgcctcctgggttcacactactctgcctaagcctcccgagcagctgggattacaggcgcccgccaccatgctagttttttttgtatttttagtagaaacagggtttcaccgtgttaaccaggatggtctcgatctcctgacctcgtgatccacccgcctcggcctcccaaagtgctgggattacaggcgtgagccaccgtgcctggcctaatttttgtatttttagtagagacaggatttcgccatgttggccaggctggtcttgaactcctgacctcaagtgatccaccagccttgacctctcaaactgttaggattacaggcatgagccactgtgcccaactgaaacaagtttttaaagtctctaattgtccatctacaaagctctcagtcttaagaacaaaatctacaggaaattagggaaggagagaagcagcatcttgctctttctaggcaagaagttccagctgtaagactggatgctggggacggcttcatttctttcacttgagaaactgaggatttccacagtgcaaaccttgcttaatgtgtatatcagtcagtcaggagaggctcagctgctgtaacagatactccccagaaactaggtggcttgaagtaacaaaggctcattcctcactcagacttcttgaccacagtggctttctagggagtttctgctcaccctaggtgtgcaggttcctggccaatacaatgatgctggtctgggaatttgccagttgctgtgcatgagagaaaaagagaaaaatttaggagggtcttgaactggcagccacatgctcctgtccagaggtgacgctcatcacttctgtttgcaatgtgttgatcagaactagtcacatggccccacttatgtcctcgagggagccaggaattctatcacattcccaggagcactaaggactactgatgaccaccacagagcctctatcagggctgaataattacaatttggattttttttttttttagatggagtttcactcttgttgcccaggctggagtgcaatggtgccatctcggctcactgcaacctccaacgcccgggttcaagcgattctcctgccttggcctcctgagtagctgggattacaggcacccaccatcatacccagctaattttttgtgtttttagtagagacggggtttcaccatgtagccaggctggtctccaactcctgacctcaggtgatccacctgcctcagcctcccaaagtgggaggcctgattacaggcacgagccaccgtgcccagccacaatttggatattttattaatcatgagttctttttttaacattcatttttatttttaaaaacattgcattaagacattctttattttgatttctgagtttctggctctcccgtacattttgcatctaagacccgtgcttgctgcgaacagagggaggataaaaaataacaattttgactgaaattttgttttcatgagagagccctagagaaaagcagtacttacagagaggcaagaatatagttgacatctacataaatattgacagaaaaagaaaaggatgagaaacacactgtaacagaaaagagaaaacaaaaaggaggtcaatttgagattgagattgctgaggtacatgctgctcgggctctttatttagtcagcacatggtataggaaaacttttgtgttcaatttccccagtgaccttccaagtacattatgaagacaattaaaacccgtatcccagaaccacaaagttttcagcgattgggctaatgttaatcagtgtgaattgaacgaaaacagcttgttcaagtaaaatcgattgaaatcttgacgagcaaaaatggaaattttggttgcaagtgtttactttctttttgtaggaacactgttgtataagatttttaaaagtacaaattactggaagcccacagatgcttctgtaagatgccagagaaattaattttggtaaagatctaggatgttttcaatttatcgaactgtacatatatagcaatttaacttatcttggtacttggtatgatttttcttttaaccaatgtcttgaattttgttcttgtgtggatttcatttgagtgtgaatctataaaattgacctagattccttctcggcagtagaattgatctccttttttttcccgatttgccttgtaaaatgcatctgtgaacttgcctgataaagttgaaaagagaacttcttcaaagatcaaaattatttgctaaatgtgtttctatacttggaacatcagtgaaatatacacctaaatatggggtgaaagtaagagaaacttcttgactacaacattgctttaatcttggggactttacgttccttagaaaatcccaacatcccgagggcaacctcacaatggatatgatcactacataagtatccaggaaaataaaaacagcttgagtttttgaggaactctctttttaaaactcttgaagtaccgtgtattgtgctctgaagggtgatgctgagtacttggcattagcttttcttagggatttgttcacatggtccccttcagaagaatgacttggcaaacaaactttgctgtcactgggagtcttttaacaccacctcagtaaaccgcagccagggggctcgctttccccattgcctcactggggaaaattaaggtcttagagagaagcattaatatctgggagaggttggttaatgggtacaaaaatacaattagaaagagtaagttgtagtatttaatcgtagagaaattgtagttgaaataatctattgtatatttcaaaagagctagaagagaattgtaatgtccccaacacaaagaaaagataaatgtttgaagtgatgaatatctcaattaccctgacttgatcattacacactgtgtacaggtatcaatatatcacatgtactccccaaataggtacaactatcataaagtagttatataatacaactacaataaagataatacaataatgtctgttccctgggatcaagcttactaggagaagagggcctggaggcagggaacctaaggacttcccagaactaaatcaagtggaaatgcttcagctatgacaggaaatatcctcttcatttacatagggcgtgcaccaagtaaatgactttgtaactttacttcatcctcttcatttacatagggcgtacaccaagtaaccaatggaaacctctagagagtatttaaaccccagaaaattctgtaactgggctcttgagcccctatactcaggcccgctcccacaccgtggagtgtactttcaacacatctctctgtttgttgcttcattctttccttgctttgtgtgttttgtccaattcttgggaacctggacaccctccaccagtaacactgtggcccttggggaacgagtcattaaaattttaacgacaagtgcagctcttcgaaggatattccagtcaaaggaagagcatcaaagaagaggttttttgcttgggttactggcaatcaaagaatgtgtcactaacacctggacggggttttgaagtactagcaggagttcctcaggttcacagaggagtgctatgagggaggacagccaaggtatgtggagcaggtgcggagaggggggggcacatggagcagagggccttggtgcctctccagggcccttttccggatctgtgaaccaaccttaactctcttgcaggagatggaagggcctggatgtttaggttaccctcgcctcccacaagagttgcccatggttcaaaagccaattgtctccgtcgctaagggtgggacagaatccaaggcacaacctatactctaggggccccttgggttgaagctgagtccgtgaccacccctgaaaatgcactgttgctggcttctcctcctccctacttggctttgcccacctctttctgtccctgcgggagaacatcctcaggaaatccccggggcctgggtccttgctcagggcctcctgggagaacccagcctcagaggatgcgtttcaggacaggaactcccagaaggaccatgggagttgtgtgtttggaaattgtaaatataagatcaaacgaatggatacggccggtgaaaatactttgtaaactacaagtgctttaccctattagcagtaattgttttccatttacaactgtctttcccaacaggccttgggaatactttattgggtcagttcatcctcctcctaccgctgttgccagcgccctttataacattctgtgtgatgagtgcacctgctacctggggaggtgggtggggcgaatgaaagtcgattacttaaatctggatgacaaatgccctgcctttactcccctggattcaaagcttttatttggcccaatggagctttcctggggcttcatctcttagcacattgcttactatcgcagagctatttgttttataaactcaactccttaaacccaatgaaaaacaatggcttcaaagcagctttttccattctgtgaacacaggaaaaaaaatagcagtaaatcagaaacttctcatctgagacagttattttatctttttggcactggcccttagagaacaggaggtagaatccacccgagcccctcgtctctctgtggagtcttccacaacgtgcataacatcccagccgctgtggaacgtggccgaggccagccccagcttgatttaatgctctccgtagctgagtttctttgccccaggctcaataagctgtaaagaatagatcctctgacaaattgacagcttttgcttcagagatgtaaagccaatgggaaaacctacaacagggcaattctctttttattcaattcatttggagaaataatcatcagaataatgatctattttagggaaaggtggatggaaacttaggctatttgtagaattttctcctaggtttaaaataacattatcctaaactcttcctttccttccttcctccctcccctccttccttcctctctaccttgaacttgactacagccttatactttgtgtgaggttcagtgtgaattcagaagagaacttataaaacatctataaaattaaaagaaatcaattggcactgcagccctataaactcttcttccataaaagccattctgtgccacttctcatctcctgggaggcaagagtggtaaaggctcacacttccaggggagggcaagttcaatggcaagctatctgactttgggcgactataatcctatgaatctcagtttgctgaggtgcaaaaaggtgataattatgcctcctgtgctgggtaatagaaagcaaacagataatgccctttcatggaaactagcacatactaagagttaatcaaagataggcattattatcattcttgctacacaaacttggataaacaaagcaagggctgggaacaggaaaggaaagagaaagcttaaggaaaaattagattttttttttaaaaatgcagcattggaagagctatttaaatggtttctttaagtctgttgtggagagaaaactgcatatatgggtgtgggtgggtgcagagggtgggggttgactgacaagagcatcagggtgttggggaccccttcagatacatgagaattccccttggcaatgtccaaagtggaccggaaggtgggagtcaacactagcagcatttttttttttttttttttgggagacagcatctcactctgtcacccaggctggagtacagtggcgtcatcttggctcactgcaacctcggcctcccaggttcaagcaattctcctgcctcagcctcccaagtagctgggattacaggcacccgccaccaagcccagctaattcttgtattttttttttttttttagtagagacggagttacactgtattggccagcctggactcaaactcctgaccctgttatctgcatgctttggcctcccaaagtgctgggattataggtgtgagccactgtgcctggcaagcagcaactattttaatcccaaacacagcttccttcgccatccagttccttcttctcttctcccacctcctccttctcctcctcctctctcttttgtataaccctctatatttcatcagaaatacagtcaagaaggggtcattggagcatgataagcaaacaatcttcacagtcatcacagggccaggatagagttttgtcattttttcttttttccatgattttatattccaccttgtctgcagtcagaaattggcatttgaaaatgcagtttatatggtcctgtttagaaagttagggtgaggcttgcttttttgagctggcaagaacaataaagacctaggaagatgacaggataggggaagaggagctttgttagatgggcgacgtgctgacggttttggaagctgcgttgaaattgaatttcttgcacaaacgtcgtcgacacatgcactttcccatcctcatggcagatgtcataagagaattattggtgtagtgaattcttgcccaatttctcccgctttaatcccattttacacatacttcttggcttccctgttataaaagccagagcgtttttgaaagcaaatgccctaaaaattcacacattctcgttctacagggagacatcgccaaaagctaaaatatccaggaaagggagagatgatgcataaactaatcaccaagaaaatgataaaaattcatcactagaaagtctggctttttaagtatccttttctagattcagttttttaagaaccaggtcaaaacctgatactttggaaggaagaccttacaaattacattggaaaatcctggagtgtttatgtattaccctcattgcacctgagaaaaatcttttgaataaatatatgtaggtactgcatctctgaataattttttgttagggcaaaagatccattaaggtaaatatcatcaatcagacaattataagtattcaaaatgattgattctatcgaattaagagtgatttcagggatatgaaactccttaattcacacattaaaaaattttaccacttatttttcattaatgtacagtaaaaatgataataaatcaagcagatctcagtttgaacagaggtgattgtagttgatacttaaaaaatagcctcattaagactcacgtttattaatgatctaccctgtcacacacactggccaaagtttgatctggagtcctagcatgtatgtattgatttatgaacctgctttggattattacctgagcagagaaattgtattcagccacagaattcaggctttgaattttggaactttctatccagggtccagtaaatgtcagcgtggaaggtaatgggccaggcaaataaacccccgtcatgatcatgcgggtgggatgatctcgctgtagcctgacttgggtgagttagtttacatgaagctgctgcctgaattcgctatgtggccaggctttgccaacatattcatgtgtaggaagcgtggacgtttcctctccagtgtttgaaaatcttgtgtgtgagtttcctatgaatgccgtaacaaattgccacaaagctggtggcttaaaataacacaaaggtattctctcacagctctggaggccagaagtctgaaatcactgggctgaaatcaaggcgttggtggagccacacaccccgctggaagctccagggaagattcatttctttgctttttccagcttgtcgtggccgcctttgttccttggtttgtagctccttcctccatccacaaagtgcatcacctcaacctctgcctctgtctctgcagtcacttttccttagaaggtcacactcacagttccagggatagcaacttggctatctttgggggcctttattcagccgaccccatcgtagaatacaaactatgaaatgtgaccacgtccttattaaaaaccagtcgggtgtggcgtcttatgcctctaatcccaacactttgggaggccgaggcaggcagatcacctgaggtcaggagttcgagaccagcctggccaacatgatgaaacaccattgctactgaaaacacaaaaattagctgggcgtggtggtgggcacctgtaatcccagctagtcaggaggtggaggcacaagaattgcttgaacccaggaggtggaggttgcagtgagccaagatcatgccactgcactccagcctgggcaacagagcgagactgtgtctaaaaaaaaaaacaaacaagtaattctagggcagtttacattttatttaaatttcttaaactaagaaaataatatgcacatggtaaaacaaaacaaaaaaaccaagcagtacaaatgatggacaatgaaaagtgagcgggcctttcactcctgacggtgttctgtggataggaactgccctggctttacaactgaaggccccacatcgcaggaggtccctcagtcccagacaaaccagacagcagcttaccctgttccagttccataccctaccccagagcttgccatagttacttgttttttgtgtatccttctgaaagtttccacatatataacacaaatttttaactcaattggaaaatacctttttaattatcttggcatttttttccttatcggcgcatctagttttatctctctccctcttttttttttaatccattatgtggtatttcattgaatgaatgtaccatgattcattaaaacattcctttttaacagtaaacatgtgaattattttcaggactttctttgccactacagtgtaatttacatcattgtatgcatatttctttccctatatattgttagtttattgctgaacatcattccattgtataaatatactacaatttgcttccttttcccttggtaaatagacattttattgtttccagtttttggctatgaataaagctgctgcatttattataaatttttgtatgaacatacgttttcatttctcttgaataaataccaagagtagagtggctgggtcgtggagcttttgcacggtcagctttacaagaccctgccaaatacttttcaaaggtatttgtatacattttctcacctgccagcactgtatgagagtccagttgccctacattcttgccaacacatggtattgtcagtcttttccacattagccattcagatggatgtgtaatggtatttcattgtggttttaatttgcattttttgatcacgaatgagtttaaatgattcttcattggtttatcggccatctggttgtcttcttaaggagttgcctgttcacgtcttcttcctattgttctgtcgggttgcctgccatgttcttagtgacttgaaggagttcttttcatattctggatataaatcttttatcagattgcaatggacaaatgtttgtgtcgcccccaaattcatacattgaagtcctaatccctaatgtgatagaattagtaggagaggactttgggaggaaattagatcatgagggtggtaccctcataaatggggtcagtgccctcatgataggcacccctgagagttctgcctgttgtcgccatgtgaggatacaatgagaaggtggccatctgttccaggaagcaggccttcagcagacatgaatcttccagttccttgatcttaaacttcttagcctccagaagaagtgtgagaaataaatttctgttgtttattaaccacccagtctatggtattgtgttataaccgcctgaactgcctaggacatagatgtatggactgaaaagattatttctccctgggttcccattcactctcttactagtgtcttttattgaacagaggttcttcatgataacctcttccggtttatcaaacttttttcgtggtcaatgcccttttaggtccttctggatcatttttagaaatctttggctattccaaggtcataccaatgctctcctatgtgatctaggaatataaaccacctggaatttattactgtgcttgttgtgagggactaagactcattttttaaaatatgactatttaattgactcagcaccatttattcgagggaccttcttttccacatcactctgtaatgccgccttcgtcataaatcaagtgaatgtatacctgtgggtctttttctagactctctattctgtttcactagatgtaatttgataaaggaaaaataaagaattctgacctttcttgcatctgcgtgccttgaagcatatttgtaccatctggataacatcgttttgatcagaatatgcccaaggagtgttttgagtgctttaacttgttcccttcagtaagataaagtgcttcagttcatcctaattagcttctctatcctttttccatgttttaggaggaaataagccagtgacagctttgggggagggtctctcgggaaagcttccactggagagtactctgggccgggcctgctgaagtcaggggctctgcccgggcattggcctgtttctccagcgttcctcttcttatcatgcaccagcttatttcttcctggctcaacataaccttgatgtttttttccaagtggtcaaaaccctgtctgttcattctcacctttgctcatcctgggtgcctctcccagcaaggcctctcccctgttttgggtctacacaaagtttatcccccagtctgatgtcttctataaagcctctcctagtcacgtcagcccttatcaatctttctctcctcagaaccctacagctgctgttatttctgaatcgcttgttccggcctttgtatcattattaaatatttcacaagtgcttgtcttgtctctcaggctggaagcccagctctgcaggaggtggaagcccagctctgcaggaggtcaaagcccctctcttaaagcagttgctcaataaatatttcacccaggatgaaggaaagcatggtcagggagtgggggcagcggggagtgatgtgctttagggtgctgaggtgcagaggaagggcctgctcccagtggggaattcagacagtgccccacacgccccaaatgcctggcgttcatatggtgtcggcttattgagaactgccctaaaaccctcggttcatgtttcaaagtgtgactcagaaaagacaccagctcttacatggggcagagggtggcataacttgggatgataagacaactcagttctgagtcagaactttcatttcagtggaaaatggaagcaacgctgacattctccttccacctgagagcaagcctgacaccaagaaagctgtgggaataggagggatgggcccggacaccgccatctccaaactgctcaagatgtgtcatctgcatagataaactggcacacctgtggatgggacatcctttaagtagatgttaaacaagatccaagattggcgtaatgagccttcagtggactgtcatgattaactgcgcatgctggctggcacaccagagaaagctgatgagttggaggtaaagtgagacaaatatggaaagacattccagttgtttgggggatttttgtcacttcctccagatggatgattttgggtttttgtccctgggtcttgatagatgttctccacttaacttccctgaggtttctggcaggatggagggaggtgatctgcagtctgtttccctattaaaaaccatttccccggacttgaaaagttgccaactcagtcgtctctgatttactgatttctaacaagtgtgcagtgtaaaaataaagcccctggtcggtttttggggcgacttgcatcatttgtagtcacccgatgatgggtttgctgtttgctatgggaacatcccaaggaactcattaatcatttcctcctgaatatcccttaggtcccaagcagaggtgaatggaaatagaattagatggcataatgcatttctgataacaacagctcaagactcacggcttaagagcctgaaccttaaattccccctagtgttccctgagtggagagatgtttcaccccacaggggtcctagactgtgcagagcttctccatctgcccagagagggtgcttagctcatcagggactgcagagggaagctcagccaagaggaagtatgagtatgttaatgggaaagtgagccctcgccgcgtgctgcctgcccctaaaagctgaaaaagaggaagtattatgtcttgggtttaggaccactgggctcccagctcctggtttttcatgcagtcccaggcttgagacctcctccctggtcctggctcagagcccaagtcttaccctggactaaggaaaagaatgccacatacccctccccacaacatgaactcccccaaatggtgccaaatatgcacaatgggaatgtatttgtctcagatgattttgagaagctctggttatttatggcctttagttataaatcaagcaaaggaggtatctgataacaatccttcattgaagaaggaaaggcaggattatggtatggagtccttcattcacttctcctaggttagagaccagagaagcctggattactcatagcaaccattcctatatggataggggatgtcagctgctggaaagggccattgtattaacctggtgatcaagcaaaacactgtatgttgctgtacaagtcagggttctccagagggacagaactaataggatagatgtatatatgaaagggagtttattaaggagaattgactcacacgatcacaaggtgaagtcccacggtaggccgtctgcaagctgaggagcaaggaagccagtagtgactcaatccgagtcccaaaacctcaaaagtagggaagctgacagggcagccttcagtctgtggccaaaggcctgagagcccccagcaaaccactggtgtaagtcccagagtccaaagaccaaagaacctggagtctgatgtccaagggcaggaagtatctagcacaggagaaggaagaaaaccaggaacctcagcaagccagcttatcccaccttcttccacctgctgtgttctagccaggctggcagctgattggatggtgcctacccacattgagggagggtcttcctctcccagtccaccgactcaaaggttaatcttctctggcagcactgtcacagacacacccagaaacaatactttgccagccatctaggcagcattcaatccaataaaattgacacctaatgttaaccatcactgttgcttacctcagtagcaagatcactatattgacggttttagtgctatctcaaaaaggtggggcaggggctgaggggcaagggcggatgatttgtaaagtttttagggttagtttaaggtagttcgttgaatgcaggggaaaggagatgctgattgggatcaggcaaaatttgtgatggaatagttcaggcatggtgggcacagctagacaaaagtttcaaggcagacttgaggagtaaatagatgtgtcataaacccagcagagagatctatttttccaagaagtgggttactaccccgatgagggcaagctgagtagtctactgtttagatagattttcaagaagttcttaaaacaaaataataaagtaagtcttcctcagtaagaattccctggaaaagtaatgttaacatagcctgttggagtaaagtggtgtcaatgtaagcaagaagctgtgtggctaaagacagttttaccattctaccctttgcttataattttagcatctgcgtggagggagggaatgtctatgtggttctcagctacctaataaatgtggaggatatttctcaaatgggataagctgaaggcaagagtagaccaatcctgatgaaatcgtgtttctttctaagagagatataggaaggagaggcaagaaaagaatctcttcaatacttctcatgtgatgggcactatgttcacaagcattttctcattttaactgttacgctgatcttacaaagttgatattattcccgttaattggttaggaagactgaggcttgaagaagatatgtaccttatgttaaagactccccttaacctaactccggtcaggctcctctaagccctcaaatccccaaccttgggttctatccttggcctttttattccagttttagcaagaattctgctgggtcagtttagtgaaaatctcccacccttgatacttgatccatttcctcatcccccatcctggcctccctttagcaataatcctgtcacgtcaatctaacaagaatcctttagctttcatgtttcctcttaataattttttacccactgaccctcactttgctccttggctaccaattcgcacttgcccttgttgactgtagagttgacgccatctctctctcctactgcaaagccccacgatagggtccccttgaataaagcctgccttcccattattaacatgtgtcatatcaatttttcttaaatagttacacagtcaggaagtggagaagctgggatgggaacctgtctgtaggtgtccaatcttgagctacgcactgtgctgtcactatgctggtgcaatggaggccacccttgtgggctacactcccatcctgcgtcctcacaccatctgctgtgtgggccttcccttggctactcttgggagaaaccgagtgtcgggcctggataaatgccttgctctccagggtcactgcatcctgctgttgcatgtgctggtcttcccatagtggctgctgctagagttctcaatgtcacccctgctttaaagtcctgaaggacctcccctcaccagtagggcaaaatctaaattcctctgtgacaagaatcatcactagctcaattttggaatggtagaggagccacagaaaggatatgggagaaaatgcaaaatccagtggcatattattacaattatgatacagctgtgttcaagggtaaagaaacatggaattcattgatgtagcgataaaaacagcttgtaaataatcttttcctgcacaaatgctcatctcctctgttcccccaccttctttgccaccacctttaatataccttggactatttttttttttctcacaggtccctcacctctaaaatctccaaacctttctgctaagttatctccttctgataacatttaaaggctttatcctgaagtctcccacatctggatagccttctactagagagaattaagctctcctgtctgtgtgcccttcagaatgtaaccacgtgatttccccagccctgtgtcctacccatctccatccatccatttagccatctcaccattctttaatgcatccatttgtcaattcatttatttattttttcattcattcatccttgcatcccctactccttccatttatccatggaggaaatgtttgtttaaaaccctatatgaaacctgatcctggatttcatcttcttttggatcagattggcctcattctgttccaaggccacagagtcaagggacaattccagaaaaccatctcaggagtgtggctctcaatctcatgttgcattttatgttggatcggtccagcctctcctcggtacagcactgttaattgttttctcaaccaagggagatccaagacagtaatgttcagtctgattttagatgaagaatccaagacttctgccatggtcattgaagcattactccaaattgccaagatatggaatcaattatatcttgatatgttcctcagtggatgaatggataaagaaatatgtacatacacaatggaatactatttagccataaaaggaaggaattctgtggtttacaatgtggatgagcctggaggacattatgttaagtgaaataagccagacacagaaagacaactactacatgatcttacttatatgtggaatctagaaggtgaactcagaaacagggagtagaatggtggttccagaggttgtggcagggtggggaagaaggggcaagatgttggtcaaagaatacaaaacttctggtagacaggaggaataaattgaagagatctgatgtacatcatggtgactacagtttaaaaaacaatgtgttgcatacttgaaaatttctaacagagtaggttttaagtgtttttgctgcaaagaagtaagtatatgaggcaatgtatatgccaattagcttgatttagccatgctgcaatgtgtgcatatatcaaaagacaccataaatagatgcaatttttatctgttgattaaaaaaataaacaaaaacaagaaaaaaaagaatccaggtgtgctgggtcctgcttcttctgacctagagaacacccagaataagtgcagtggtgccaaggaccgaacagttaaagtcagtgcagctatatccgttaattttagctttaggagggttataaatatagagaatcatgcatatttcaccatcaaactgatactcaattactcttttttttgtcatctcaagagcaaatgaactctggtaaatggactgagaagagaaactttggaaagtgacaccaagcaatcagacacagaaaaaatgaccccaatgtttggagatttctaactgatcattctttcttagatgcctcctgtcgtgggaatagaaaagagtgggggataatttttgactttgctttaaaattttcataataggaaaaggctcccattctaattcaagagatgacaccttaacaacctttctcctcataaaacattccccagctccttgtggctgttgcgtaaccaggagggtcctgccatgaaatagaactggagtttcttccccagtcatagccacacttcccaagggaactggatgtctgtgatcgttatgaattaaaggctcagtcttcattacatcagtgtcagcctgtattaacagatctcaacattttctctaaaggcaggtatttttatttgtcgaggaatcaggactctcttctctgattctgacttacagcctgcaaatccagtgtgcacggctcatttttcttttccttctccactgagattggcttgtgtgactattccattcatcaggcatggagtgagggaaacgcacacttcatttgctttgtggccactgccttattttccctattttggtctgaaaagaaccaataaaccttctatcttcaaattttcagaggagtactttccatctagctggttcttgaatgctttaaaatggaaaaaagaacagaaaacaggttgctgtttgggtgatttgcaagcgctctgaaattactgtttttctgcttcacagactcggtgactgacagtgccttcccccagatagtcagccagtggcattggccacgacggtgctgctccaaattgagtatttttttcttaatgtcagtgtctactgaatgaaaactagaattaatttttcatgggctaatagttgtgcatagctacagtgtacctgctgagtttacggactttgcaaataacatttagtctcctttttttttttttctttttgtcatccctggtctctggagaattttacttttcgacggttttagcccttcctcatatctggctgattttgataagagcagatgaattacccaacgtggaatatgagaaaattctttgtagagggggtccagtggtcataggtgcatttgactggggctccaatttgtgcacagcccccttgtgccccagctgtgtccggggtgagaagccactggcctgaggtcactgtagcacacctttcctccctatagaccaaggtttctccctcttggcactattcacatttggtttggggggctgccctgtgcattattggatgtttagtggtaccctggcttctacacattagataccagtagcactgtttccccaggcggtgacaaccaaaactgctttcagacattgccaaatgcctctggggtggtgatggggaatggtccccacatgaagatgttctccctctgggctccttgagtgagagtcccaggtgagagttgggatgaatgcagaaagaggaggaaaagagggcaggaaatcaggaaaaagatggactctggggcgcgtcggcctttgctgagatccagatgaaaaaattcgctggttacctactctggctaagtgttagaattacctggggagctttaaaaaaatccactgtccgagcctggcccaaggatcctgaattaattggtttgaggacgtaccctgctatcagcattttcttctcaagtccccttggtggctgtaatgtgcggccagggttgaagaccaaggtcaggagcagagtcgctcactgtgaggccgtgctcgtcctgccggcggctgcatgaggccgggagctgtgctgtcgaggcattcactttaccttcctgaatttttctcaacaagtgtcttcgagttctcgaagctgagaccctgggcattactaatgtcacctgggctgctcaagtagctccttcgaataaccaccaaaagaactcaaccccagcttgaccaacatggagaaaccccgtctctactaaaaatacagaaaattagccgggtgcggtggcgcatgccagtaatcccagctactcgggaggctgaggtaggagaatcgcttgaacccaggaggcggaggttgcagtgagccgggatcgcgccactgtactccagcctgggcaacaagagggaaactccgtctcagggaaaaaaaaaaaaaaaagaactcaaccagtgaaaaaagcaggccccacctcagtcatacatagacttctgctgcatttcttagaaaatgctcctttgccttcttttgccagcaggtgagtgcacgcatttgtctaagcgacagggaactgcccgtgcaaggaaggagggccgagcgggtggagagggatgtggaaatgggagccacctgcgatgctctgtatctccctgtagggatggcagtagctaaagaatggtgagaaccagaacaccagagacagggagggagagatgaacaaccaggtagtcatctaacctcaaataacagcataacagttataaacagcaaattctaccaagtattcaattaaccccaatggaaatagaaaaggaggagcagagaaaccaaaaatagatgggatgaacaagaaacaaatagtaaaatagtagatccgaatcccactttatctttcaaatgtaaatgtaagagcccatcatgtgtaaatggactaaacactctaagaggcagaggtagtctggatggatataaaagcaaggcccaactcaagaaagcaagatgtgctttaaatacacagatatagataggttgaaagacatgcaagtaagtaggtgttaaaagatgtaccatgcgtatagcgtaaaaatactggggtagctatatattaatatcagataatacacatcacaacaaaaaatattaccagagataaagagggacactttataatgacaaagggtcaattaatcaggaagttaaaacaatcatagatgtatatgtcccaaatcacagatcttcaaataaaaatacacatgactaatttaaagcaaacgttataccatgccatgtggaatttataatagatatgatagctacagcatctaggatggaagacagatcaagtgaccagtaaggctgcaagtttcattatgttatatgaagtagtaccttagaagtaagtaggctgtgcactatgtaccatagcaaagacttggaaccaacccaaatgcccagcaatgatagactgaataaagaaaatgtggcacgtattcaccatggaatactatgcagccataaaaaaggatgagttcatgtcctttgcaggtacatggatgaagctggaaaccatcattctcagcaaactaacacgggatgaagctggaaaccatcattctcagcaaactaacacaggaacagaaaaccaaacaccacatgttcccactcataagtgggagttgaacaatgagaacacatggacacagggaggggaacatcacacactggggcctgtcggggggtggcgggctgggggagggatagcattaggagaaatacctaatgtagatgatgggttgatgggtgcagcaaaccaccatggcacgtgtatacctatgtaacaaatctgcacgttctgcacatgtatcacagcacttaaagtttaattaacaaaaaaaagaagtaggctgtgaaaagataaagatgtatagtctaatccctagaatgaccacttaaagtgcaaagataaatagttaaaaaatcaatagctgtattacagtggcattctaacaaatattcattcaacacaccaatgcacacatactcccactcctcacatacctctttcttttggatgatggaatctaccaaacgaataataacatagtggatctttcatgaaggcaagtacttccttagcttttctaatataaagtagctccataattagttgtaatttcggtaaattattgcccattataaactgctaattcgatacatgttcattcctttccgtagctaatttagaaagtcttcacagtggggttgattctggtttgtggattttgtgcgtctggttttgtcaagtagaatggtccaactatcagttccaggcctcagtagaaagtaacccacgtagtctcactttcctgaggatcctcaataaacttcctagaagatgtaactcttgagatttcctgaatgctgagttctgccagtgacaggtgtaatcaccgtttacattcctgatgttagtagagaaaaatgaggcaggcccattggggaactcacacaggaatagacaatgatttaacgcataacaatgtgatgatcgtggctttgggtctggtcactgtttccgtgagcatgtaccaagatggtatgagctgtccttgcagcaagatggaaagtgcattccactagctcccttagaccttctcgcatggattgtggttccctgtgggccccccacatcctgtattcgtttgattgacttctcagtcaagtctctacatttgttttattaatgtcactttgaaatcttgtcaagaggcaggcatggtggctcatgcctgtaatcccagcacttgggaggctaaggcaggtggatcaactgaggtcaagagttcgaaaccaggctgaccaatgtggtgaaaccccgtctctactaaaaatacaaaaattagccgggtgtggttgtgggagcctgtaatcccagctacttgggaggctgagacaggggaatcgcttgaacccaggaggcagatgttgcagtgagccgatatcgtgccattgcactccagcctgggcaacaagagcaaaactccatcccccttccccacaaaggagttaattggattaaaatgaatgagaaacagtacatagggagggtaggtgagagctctacaggatagatagtaattgaagaatgggtaaactgttaacagaggtaggtgaatgaagtggagaaaacagtgtaattaaagacatagaggtgagaactcactggaaagtgatccaggctcaggaagcaagggagctggccagcatgtggaggtggcattggaggtttgtggtaaggccagagagatggacaggaggcagattctggagggctttgaacacgaagtccaaacttttgttacataacttgacacaaaattttgaaaagcacttttttttaagctagaaggtgtcttgtttggggctaggctttaggaagatgcacctagcaccagtctgtgttggaggaattagagagaggggaggggttgacatgtgacctggctcctcttttgtctacatgaaaggatttctggatggagtagggcaatcactttccttcctctccggcctttttctttttctttctttttttttttttgacaagtggatggctgcctcaaatgaaacaccttgaaaactcaaaatgtcagactcaaagagtcctctcccacattgagagctttagagagctagtgacaggcactcagaaaagagagcccatatggcctgcttcagtaaagggatgcttgagttgttaattcctaaaaaaaccatcgtccgtgtaacagttgcttccatgccctctcagcattgaaatgggacttcccattattcctcaagtcttctctcttccctctttaattcacaaaagattttctgagagcttaccgtgtgtcaggcactgttaggacttggaatattctatttagttctttttctaaaaacatccattgctgtgatgatgattattacatatgtgatatatatcttattattatccttgcttcagtttacttatgaggaaacagagactcagagaggttaagtaactttctcaatgtcacacagccagaaggaaaccgagatgtggtttccaatgtcttgtctggacaaattaaatattacatgaagaacatcataacaaaaaatattaccagagacaaagagggacactgtattagtctgttcttatgctgttaataaagatatacccaagactgggtaatttataaaggaaagaggtttaattgactcacagttccacatggctggggaggcctcacaatcatggcggaaagtgaatgaggagcaaagtcacatcttacgtggctgcaggcaggagagcttgtgcagggggactcccatttatgaaaccatcctatctcatgagactcatgcactagcacaagaacagcatggaggaaaccacccccatgattcaattatctccacctggccctgcccttgacacatggggattattgcaattaaaagtgagatttgggtggggacacagctaaaccatatcagacattttataatgataaagggtcaattaatcaggaagttaagacaatcataagtgtatatctcccaaattacagatcttcaaataaaaatacatgtgactaatttaaagtgaacattataccatgacatgtgagatttataatgtatataaatacaaacattataaaaagtaacatgtacaatagtaatgtctgtaatacctttacatacaattactatactatttaatatcttttgattatcaagtggttactatgtcccagcactttagacacatacattaattctcacaaccccattataaggtattattatcccaaaatgtggcagagagagctaagattactgcctaagttctcttagctagtaattaagtgagctggattgaactcttagtaagtggtatggggtgtagacactggaatttgggtttatctgacccaaaacctgtggttaaatttgtttgaagaagagtctaatgatcatctacctcttccaccatttacctaaggttttctgagcacctacaatgttctagacactttacatgtgatcacatttagtcctgaactctgtgaggtgggcattcttctcctttcaaagaatggggatccaagtctccaagcagcaaaattattcaccaggatcatttgccagcaagtggctgatgagagattaaaatccaagtgcgtcagacgttagatactgcttcatacaaaaatctgtctttcaccaagaaaacccatgcttcaacagagttacatagttctccattttgttcccacaggctagactaggagggaggagctgccccgaaggcctgggtttcttcttagaccctctcaggtcaggttcaggggatagcatttctctctggctgagaactgctatagagtttccatgtttcatataccatacaatgatgttaaaaaacacaatttcaatgtatttagtttaaaaatttaattggcttttgttagcaactcatgaattgggcagcctctcatctaaaaatggagagacactccattaggcatggccaaagtggatttttataaagtagcttgagtaggaacaaggaaatggcataatctaaaaaggggattgggaaacaccaggttactttacttgtaaggggtaacgtagaggaggcttccttatcatgctgcctaacactcgaccgtttgtggatttggccaccatctctctcctgatttctcagaaggtcagataaacaactaagttttggtttggtgatgtggaactttagcataagtgagtccattttggtttgatctgctggggcctagtgcagaagctcagtccatatcaataggctctcgtaaattttatttaacagtgattaaaatgggaaaccattaaaattaaaattatagcaactgacttatgagaaaatgtttattacgtactgttaagtggggaaaggcaggatgcaataaagatctgcataaaatagaaatgcatatctacagaatctggaatgaagtacacaaaagtggagagtgagaaaggtcatattatgggtgattttttggttggggggggtgccatttttgaaattgtctttagtgttccttctcagtatgggttttcatgtagggaaggggatttgtattggagagtcacatattaaaaacatataaatcacaagttgtattagtccattttcatgcttctgataaagacatacctgagactgggcaatttacaaaagaaagaagtttattggtcttacagttctacatgactggggaggcctcacaatcattgtggaaggcaaggaggagcaagtcacaccttatgtggatagcagcaggcaaaaagagagagagagcttgtgcagggaaactcccatttttaaaaccatcagatctcatgagactattcactatcatgagaacagcacaggaaagacctcccccatgattcaattacctcccaccagcttcttcccatgacacatggggattgtgggagttacaattcaagataagatttgggtggagtcacaaccaaaccatatcacaaatattcatagctctctgaattttcccagactgaacaccctgtgtaccaagcactcagatcaagaaacagagcattgtcaggatccagaaacctcgcatcctccactcctattattcttaaagtaaattagaaaaacccattctctgagcatggaatggattgctcttaagtatgcaataagaagatcttggccagaaagccaaggaagaggaggctgatcacttgagtcagtaaggactgagccttcctggggcttcctactcatcattcattcttactctggaaatagcagaggtcgggtgggccgttttcagaacaggagctggtaacttggttatgcacctaaccggaaacaagaagagaaaggggctggtgtctgtccaggagatgagaagtggtgctgaggactagcccagaaacactatcccccactgaagttacaggcccagtggagctggaaccccagagcctgcagagaacaaacactgatgggccttccagaaagagagacaaggctcaagagcataattcagagaagtgaacagaccaaatagacatagttcaaaaacaagggaacagcagccaagggcctggagccagggaagaaggggttgacacccagaagttgggccctggagttacacagaaaagtgcttccagcattccttcagtgctcatggagcccctgttgcctggatgcagtggtgaatgagatagaatgagacagatgctgtggctgccctcatgggcctgatatccacagagggatgacagctatgatgggggagccaggcaggggaggggctgtgtgttcaaggctgtaggaatgcacaggtgaaaccccacctgaaggccaggtaaagtgcgcatgttgagtttggggaacagaaagcccatctcatggcagaaacagagcaaactgggagagacggattggactggagtcacagccagctcccagggaccattgcagggagcagaagcacaacatcccaacatgtctccaattggttagaaaaccaggccgggcacggtgactcacgcctgtaatcccagcactttgggaggccgaggtgggcagatcatgaggtcaagagattgaagccatcctggccaacatggtgaaaccccatctctactaaaaatacaaaaatcagctgagcatggtggcgggcacctgtagtcccagctacttgggaggctgagacaggagaatcacttgaacctgggaggcagaggttgcagtgagctgagatcacaccactgcactccagcctggcaacagagagactccgtctaaaaaaaaaaaaaagccagtgacgttgcacactcagtaacactgcaaatatgcaaatataacaatttgcaaacatattcagaaatgccaagtaaaatgtaaatttataaaactataaatgttaaaaatatgtgatcatagccacataaattctcagcagattaaatgaatacaaataaaacattagtcaaaaaataactattgacccaaagtgaaactaatttaagtaaccgtgaattttgattcacgattataaaatacgatgtaatctttcttttaaaatgctgtataaaaatataaaattgtctcaacagttcatttatgagcttttttgagggcaaattcttccagctactgaaaaatatctttcttaatctatatgcaatgagttgaagaaacagtggtggactaattctaagttaataaaaaaagttctttctgactccagaaaaattcaaataattctatttcttatttgataattttaaagatatatgattgaacactctttttttcaggaactgcactctcattgctgaagagctgctatgggttgaattctgcctcctccaaaattcatatgttgaagccctaacttccaatgtcactgcatttggggacaggtcctctaagagggtgattaaggttaaatggggtcataaggatgggatatcagtccaatatgactcacgtatcataagaagatgaagagacaccagggatatgcacacacagaaaaaaggtcatgccacaggtggacacagagagaaggcagccatctgcaagccaaggagagaggcctcaggggaaaccagccctgctgccaccttgatcttggacttccagcctctagacctgtgtaaagataaatttctgttgtttaagtcatccagtctttggttattttgttatggcagctccagctgactaatccatgagttatatatttggttgtcatttctaagagagtatgttatttgatctttgttggctttgctttcatcaggcatagatggtgaatccagtgcagggtgactataccaattttcatactatcatttttttatccaatttgtttggaaattataaaaaccagaggaagatttgttcttggaatggaaactttgccaataccacaacatgattgcttaccctggcttactctggcagagacttgtttagacttgcagtttggttatagttttgttgttgttgttattgttgtttatcttaattgaataattgagtcattgatgttgagcaaaaaccaaatgattcagcgttcatttatgatttaaaaatataaaaataatcattttacaacaaatgcattcacttcttagtacttgaaaatagcctagttattaaaatactaaaacacctaaaacccacttactggctgtatatgtgggagcagcctctctaaatttctctgaaattcacttttcttagctatgaaattatatttttatatatatatatataaaatatacacacatatatacatatatgtgtgtatatacataatatacatatacatatatatatacatacacacatatacatatatatggaatagggctgtggtcaagatgagaatcatgcatgtaaaatgttggacaaagagcccgttggtagaagacattgggtaactggctactgttgctgtctcaagacagcacaaggtgcaggtgttctgggaccctgggtacatgggatctatccacagctttgtcatggagccagaaaagcagaattcaggttggctggagccacctctggcaactctgggaaatggccataaccactgtaaccaggctgttacgtaggctattatttggtttgtcagggacccaggggccaagaacccagctgttcatacaactaaatgtgaaaagcaaggttgacacagaggaggacactctaacaattgtgcaccaagctaatgttttcactaagaagttctgtcattgtgcatgagtttggttctgctccaactttatctgcccaagaaatgaaggcagaatggttgggatagggtgctttagagatgggttcaggaaagggtgagtcagcctgccttgcttgcagatgagcatggttttatatctgccctccatcagggcggggttgctgggagaaaaatgttcgtctccacatgttggccaacacagcaaggctgtctatgtgtcagactgttcctaggcaaaatctaggagtgcaaagtaggtgttgcctgtttttgagccctttattcataatgttggggcctaaaagcccagctgcccccattggtgtccctagaccccttccgtgattgtcctgtcactaattggagccccattgggtccttccaccaactcctgcctgcagtcctgtcttgtctcctttctgtcattaaaaccttcccgtagagcattcgcttagcataatgctccccttcttgccaatgcctgccagtcctgactgcacgaggaatcacccagagatctcatttaaaatctcaacacctgagccccacccggaggacctgttgatctagttctgggaggcagagcttggaagcccatatgtcatccagtgcttggctggttctggtttgtagttgggtctggggactcagctctagcagaccagggagataatgagctccagttaagtcagccaatcctagagactgcagtagctgacacagcagcactcttcctagaaaacagaagtccttgtgccagttaaaaatctcagaggatcttccagagtggggtcattggagatctcagcatggtggtctgggcagtgtaggagggcgacacggacaggctggaaaagcttggctctttctcaagccaatgctgattaggggattcatctgtggggtataaatggcaaaagagtggggacattgtgatatcatttctgtgtgtgtgtatccatctccctcccctcagtgacctagagtaccatgaagtggaaactcaaagaattttggtatctgctgggtgtgggataggacgagggattggtcatattttaggtactgattcattttggacagaaatgggagttgagagacactcctttaggaataacttggaaaattctcattaaaaataatgatgatgataataaaacaacttagtgctttccacttggctttatgtaccggatgatttaatgcaacaatgatgcagccgtgcatggctggccgatgctggaagcccccaccccaccccaaaacatctcctgactagcctaactagccattctatgcactcaatactttaatttgcaccttctattcattcactcctaacctggtgacaccccctagattactgatctctgcggttcaatttcttcatctccataaacgatataaatgcctagggaatcccagtgtgtgagaattccaactctctctctctgtttccacctggccagaagtgatgatcacaaaatgatacagaacagaatatatttttctagacttcacttccttgcacaaaacgagtagtgaaacaagtctctgaagctgtgtctctctgaaagggtagagtcggaatgcgtgctctgtggctgtcttatttgtgtttccaggaggccagcctgtttgtattctatataacatatatggcactctcccttccttaactcgattctccacacttcccacacactagctttttatttttatttttatttttagccagaaagaatgctgtgtttcttgctgttttcatgttcgcattagaggaacagcagcacgctgtcaggggtggctggtaatagactctggataacaagcacccagctcagcctggggctccctcgggaaacagaattggatgatggaagaaaataatgtcagggttcagggaggaacgtctcagctagcccatcacataaacattaaaaataaaattagaatacatgccttatgattcctcagctggagaagcaaaataaatggaaaaaattatccccaagccgtaatagcttggctccaaagaatggcttctttcctctcaccgggttgcagcatccttcccaaacattgccctcgtaagtgtccaggaactgtgacctggaggccctcaggatctctccctcaggccaaggcaggcaattacatcagcccaggggtttggtttcaagttgtcaggggtcagtgatgcaggtcactcagttcccagggcccttcctgagaattggtgctgggaataagtaggatggatagaacatccagttgggatgtctagcaccgatttggatgttggcaccaggagccaaatgacctagtttcaaagtccagccctacaacttactaggactctgagttacataacctctaggtgcttcaatttgcttatctgtggaatgggagtgaggtaaactccaccggatagatacattgggaagcataacaaacttaatgcatgtaaactccctttttgtttttaatggagatcgggttttgccatgttggccaggctggtctcgaacgcctgacctcaggtgatccacccactcgggctcccaaagtgctgggattataggcatgagccactgcgcctggccccagttttcttttttttctttttttttttaggcggagtgtcactctgtcgcccaagctctggagtgcagtggagtgatcttggctcactgcaacctccacatactggattcaagcgattctcctgcctcagcctcctaagtagctgggattacaggcgcatgccaacatgcccagctaattttttttttctttttgtatttttagtagagatagagtttcactatgtcggccaggctggtctcgaactcctgacctagtaatctgcccacctcggcctctcaaagtgctgggattacaggcttgagccactgtgtccggcctaatgcgcgtaaattcttataacagtgctgagcacagatacgtaacactgttagttgctattagtatgtttagcattttggagaccctgtaccccattttattaaagagcaactttctataaccttatgggaaaagcctttgggacaggataccaggggttggcagcccagagtccactctgctcccatgttctatgtgagcacaggtgtgcacctcattctggatcccacactgttgatctgtaatctaggagcaataatgcctggcttacgtgtgggtttccttggattgccgtgaagataacattagatgcaaaatgcccgtagttttaagcagatctcacaagttataatttttctgctctgggtctctgatacatctttttttcctcttgccaagtggatcaaatcccattttgttactcagccatcagattggattgcagaagctcagataccaagatgttaactctttggactgcaccatcatccagctcaccaggcactgtattatttgggcaattagaaatctcttgagtttattatggaacctcattttaaatacatgtttttagacttggtgtctctgctgtggcgtataacaaatgaaaaatatatcacctgtcaccatctgacatggtgcagagttacttgctagtggttggtatattatgcacttccttgctctggaatgaatgaacacttcgtttattccaggggctggtttaattcactcctgtatctacagcacctaggaagtggcctgacacataatcctctctcaaatagctgttgaatgaacagatgactcacagctcaactgaagcacaagcaccttttcatcaacaggttcaaagtttcagggagaagaaacagtgttgctttagttgagagtttaaacagttagatacttagaataattatcatagtgtaagagctacatcctgtgggggcacaaggaggcctgggacctgggtcctttgcagagagttgaaaatctagttggggagatgatgagtgaaaggaaaaccaggacaagatggggaaacagtaaatgccagatcagagctttctgagtggagtgaggtcaaagaggaaaagcagatggaagaggaaaggagagaaaggacacaggcagacaggggaaggctttgtatagcagtggggtgggctcctctccataaaggatgagtgtgatttcaatagggaaaaagggacaagcagcccagaagggggaacatggaaagatgtgtgttcagccccacctgagcagggcacgtggcctgacgacatcaaacctcactgcacgtgagggaagaggaagaaggcagaggagttgcagccaggccagggaacgtctctatggggctggccaaggtgtttgattgatgttgcccagacttgctgatggtaagaatcacttgtccaaaaaatacaaaaaacaagacatttttaaagacttcttgggcactcatgaagtctgatgttcaagggcaggaagcattcagcatgggagaaagatgaagacaggaagactcagccagtctgctcattccactttcttctgcctgctttgttctacccacactggcagctgattagatggtgcccacccaggccggatgcagtggctcatgcctgtaatcccagcactttgggaggccaaagtggttggatcacttgaggtcaggagtttgagtccagcctggccaatgcagtgaaatgctgtctctaccaaaaattagctgggtgtggtggcaggcacctgtaatcccagctactctggaggctgaggcagaagaatggcttgaacctgggaggcggaggttgcagtgagctgagactgggccattgcgctacagcctgggtgacagagcaagactctgtctcaaaaaaaaagaaaaaaagatggtgcccacccagattgagggtggatctcccttcctcagcccactgactcaaatgttaatctcctttggcaacaccctcacagacacacccagaaacaatgctttgcatccttcaatccaatcaagttgacactcgatattaacaatcacaggcactcttctaggcttattgaaccagaatctccaggattctcctttgaaaaattcaaccagtcagtcaatcaagacaaatagcccaggcaagtttgggaagtacacggtataggtgatgaacagacatggacagctgggagtggagatatgatttgacaagagctgtgtcttaggaagaataattgggaggcgatttggaggtggggattggtggaggagaatggagattggaaatcagttacaaggctactgagaaaatctgagtgggtagaagtaagggctgaagccacggaagctgccgtgggtctaaagtcaacgggatgccatgagttagacccagtatggaagggacaactggtgggacgcaacagaggagagagaggaagtcatttaatgactgggaggctacaggaagggtgaaagcatacatagaaagaataaatttcaggcagggcactaactatacagcaaggtgatggccttggtctcagagaatttgtggatcttataataatgggtgttcctttggaagactaagaaattgaacttgtgggactggggtgttggagagaggcaggcctggagattagaaatgacccttttttgtaggatagtacaatttacttgtaaacaatgctgggatttggggcactgatccctgcagtttaaaatccacatatagcttttgactaccccaaaacttaactactaatggcctcctgttgactggaagctttatggataacataaaccgtcacttattacatcttttctatgttatatgtattatatactgcattctttacaatcgaataagctagagagagaaaatgttatgtagaaaagatatttactatgtattaggtggaagtggatcatcatctttacatagagtctcagtgggggcagaggtggaggaggtggaaggggaggcaagacaggcaggcgcactgggtagaacttttattgaaaaaaattcacatataagtatgccgtttcaacccatgttgttcaacggtcaactgaatatttgcagcaaaactggcagccaagctgagaaaaatgaagaatgaaaaaggtaaaatgctattcaggccgcagtttacactaagcctgtgcagggaaggaaagcatctaaaactgctgatccagcccaaagcatgctgtgcccacagtggagagtcgtatttatttagaggcaggctggtttgacttcatctggtgaggattacatcccctactagggccggcattgtgccttcattctctcattcatcagctaattccttacaggtactgtgccctggacttgtttcgttcaaaatacatctttttcccccctcagcaaaatagagcagagttgacaagaagttctgataattactccctaaacaataaatcactatgctggtgaagtgtgttaactctacatgggacatgaatgcgtttcaagggaaaccctctcaagacaaatggcaccaagtgctgtgattacagcttcaacagacatgcagacagggctgcttcaggccctgtgctgactgccaggctagcaggaactttcagaaacagccacagtaggaatgctggagagagggagccttgctcctcaatctgccatgctttgtccttgggagaagtggagaagacgagcacaggaagggagggtgctcagttttcacccacttgtttatccattcattcctcaggtccaggatggcacccagttgtcgcaagcccttgcgggtgacctgtgttcccagccgtcgtctccatgatgggtccatcctgaccactgtttcctttgttattcaggatgctaattcttgcaaatatcaccctttcaatcaaattttattgagcacctactattctataggtgcagagaaagggctggaatatgaaaatgactgtcccggtgcttgtcctcaaggaatatacaaactattgggggagatagctgcttatataaacaaatttttaaaaagactctcatttgatctaggtagaagctgcaccaaggtccaatgtttgaagaatccagggaggcttcctagagcagaacatagtgaatgggactttgagggaaggcaggaggcacagcaccacaaacagcatggtccactggggaaacagtagttgtttagaggataaatggatagagtaccagtggcatggttttatttttaaattgtattcccttctgtatgtggttttaccattgttgtagtcactttgtcattaaatgacttcctctcctgcctatgctgggtcccaccagttttcccttttatgttgggttttgttcacagcaccctggggattaatgtagggggtactagagttgggaagcagcagaaagcatgagagtttgaatggattcttgcaattcccttgttaaaatctttaagcagcagactgacaagatcatatgtgcaactttgagagatctctctagcctgagaatgaaataacagtaacaagaggcaagagagagagagaaccattcaaaaacaccatttgttcacacattcattcaacaaatattttttgaaggcctactctgtgccgggagacaggctaggtgctgggaatatagttgtgaccaaaacagtttacaagttagtaggaaagttgggtttaaataaatagacaccaaagtcaatacatatttataatctgtggaatgaatggaattccacgatgctataaacaagtatggcagggtgtttcatttcaatgggtgatcagggcaaggccttttcaaggaaatggcatttatctgagaccaaaagaataagtagaatttaacctgccgtctttcaaagaaagactggaagcagagaagccaattaggaagctagttcagttatcccttgcaaagaagagggaatgccattggaaatgtggggaagacacctgattggagaggtctttttggagatgcagagttggcaagcctgctgcaatgtgttgagaagagatgaggctatgaatcaattcagattaagatagcatggatttgaaagaggtttggagaggaaaatccataggactgcatgaagaatagtgtggagtctgtgtcagggatggtgaagcctaggatgattgctggttttctggctctgtaacttggacagacagaggcacaaggaaccataggtggcagtaggagctgatgattgtttcagttttgagatgtgtctgagattcctgtggcacatccagggagatatgtctacacagtatacaggtgtggcctgggctgggtagcatgtaggaaccaatcaaagtacaaaggtggatgagtccagaatgtgtgtaggatccagcaaaaccattgctgagccatgcacctgaaatgtgaactgatcctatgttactgacactcttacatcagacatgaaagcaagagacagacaagaatggtggcaaattgataattgcatctcaatgccttttttaattcctaaaattactcgaagtctcaatttaatgcaatttcattctgttcatttaaagtccattatccaattagcaatggttctctctggggcttgagattgggaagaggtggttgaggggaacatttcacttatgttatgaaacttttggttttattttgcagcaaccaaatattccttatataagcaatagataaacagagtactttaaaatatttgtttacaataaaattgggcttcctttcatatgttaaatacaacttatgtgccagaaaagtgtgaaaggaaaatagaatcttgggaccccaaactcactatgccaaaggaaaagttaagcttgggaactgagtcatgtaaaaactgccttccttctgtccccagacagatagctgtaatttcacatgtttactttctcttatgtaaaatatagatttattgagcatgagaggaatgcataattgacttattgttctactccctttcttttcaaatacaaaatgtagattcacggagtgctaatcagagcctcacaagaatggaaccgcttgcctcattacctattctgacttcttcttatttttttcttttttcttcccctccttcttgcactttcccctttaaatattaaagttctcaagaccctttttggaaaaagcaaaggacacaggccctaccgtgacttctgtttctttttcccaggtgcatcctcaacacaggcaaaataaacctctaaatggattgagatctgcctctgtcacttttggtttacaaaagtgtatactgttaaagacttttcatacactttttttttatttttcaaaaagaaaaaaaaatttactcctcctcaccccatcaaaagttccacccatgacttggccactataaatgagttctggagaagtggaggtggctagggaagcaaggactgaagatgctcaaacactgggctgcaagcatatcagggtcctgctcacagctaagacctgctcagggccatccttttcttcaaaaacagactgaaacacggagggttttctctgaagccataggttgtagaagtccttgggtgacaggtgattgactggaagtagaggcgtataggagatcctgaaaatggtgagcattgcagagattccaccttttctcaaacccactcgtgtctgctacacattgacggtgactttgcaaataacacttctcggctgtctctgtgtgtttaagtggcacattgaaaaacaagacaaaggctcgtgaaagtgcatgtaataatttcttttctaatgaaatctggagaacattcagactttttcttctttaacggtgactcattgatttgtttatgactcaggaaaacttacccactggactcagttccctgactctgctcatgttggttgttgtcttcttcctggggtcaaggattgctttgatgatctcactccttctacaaactcaggggggctattgaaagatcatggctgattacagagttccttttgctatggctaagactcagtcacattcttaggaaaagaccaaaatgtgctaatgagatttttcaaataagcaagataaaaggagtttttgcagagaggaagctaagagttagatttagttgtataaaagatataggagaagcagggggtgatcagctctggattcactgtgagtccaggaatctcagatgtgactgttaacagtgccctgttttagttcaatagcacattttaaacgaagataaatgaaagaaacctctttaaaagaagatgaggctaagaaaaaggtattcgttctaatgaaagccgactgttctgcttgagacatctgcttgtttggtgtcatcttgctgtacagggccacactatgaggcatgtaggtcagtagtgggaagagcagttgatgagctaaacgaagcaaaagaaaagccaggcaattggttaactgattatttgggcatgtgtgcatcagacacttaattcaacataccttaaatgtacattaatcagtcagcaatatcatctgtgtgacaccgctctggaaaaccaaggcagaggagaaaaaataaatcaaagaatgatctacttcttcatctactagagagacaaattcactcaaaatgacttttagacatttctagaactatttcaaatgaagtgggctgcttaggaattgaagcagatcaatttggaagattagaaaaggagaagcttggacgctgtttattttaccattgcatgtaggagtcaaagtctcactcctgagacacaggcaggttgtgctgaataaggtcgtaaaccactaattctctctttctgatgaccctgaatttctgtcaaattcaatgattctgaatccacatagttaaactctggcacatagttggtgcaggaatttcaaggtccaggtcttactgccgaggtcttagcagcctggcgaagtgcaggtccactcagtgctgcagacactggatgtttccatctggcaaacagtctatggggtgctacaaattttcccccatgtaaagtctcacaaggccacataaattttccaaattacaatcacttgaacccttatcctgctcagttgcaggacagcaaattctgctctccaaggatatctgggaagcctcagggatttcttagatgttccccagtctctcttggttgccaggccagctgccacctagctcaggaccactgctcaatctgctctgcctgtggttcacaccagctcttccgcaagttgccttctgcagagaaagcatttctgtgcttgttgtagaattctcctttttctcagtcttccataggttgagcatcagccactactcctccagcaaatgttgccaagtctctctccttgagcctctttctgttcggctttggggaatcatcacactaaaagccccgtggtcatagacaagtcttggctttgactatgggtgacatgggtgctcttgcaggcaccttgcctaccaattatcatcatcttgaccaagtgcaaacagtgtctgggcacttggcctctgctgctactggcaccagcccctcttttgaccttgttgctgtgccattgtagccacctgcacaggaccaggcagggctgcctcttgcccagttcaagatgcacctgctcttctgggctcccccttctttccaccagagtaagttacaaaggttgtcttcctccattttagtgattgcccatctgacctcccaggaactgaggtgtgggggagtctgtgctctgagtctaagcaggtagatctcacccctctcctttggggcctcttactacatatatttagagaattaggaaaatgccagcacagagccaagtggtggttcaggctgttcccatgttgtatgcctcatgagccaagataccaatttctgcctctttcaaagcatattgtagtattccatttttggcaagattctctccagagtcctgtgtcatttccaaacagtctcatgaatcacctgtggctttaatccacaaagcagcatatgctaattgctacagtctctgataagtgtagggtacagtgtctgggtctttagcctatatttattcatcccagagacattaatttatgcatttatgcatccattgaagaagcacttattgtgaactctactatggactaggccacgtggtaagggaggtgcaaatggatttgagacatgggtcatatcttccagtagctttcaatccagatggccaagttcacctgtgaaacatctgaaactgtttctgcttctatcctcactagagtgaccttaggcaaatcttttaagtcctctgggtctcagtttcctcataggaaaaatggaattaaaaacacctgtcatgcatgtctctttgaactcttgtgcagaacaggttcagattgtctaataccagaaagcagaattggagcaaatggcacaaaatggcaggttctccaatataatctcagaagggattaactaaccatccaaagtaaccaccataagtgtgctgcctgccctacagtgagctctctgtgcttgcaggcattcacatgcagatgaggtgggtgcttgctagagatgctgcagttgtgttagaaacttaacttcatcccccaagatgctgtgaaacacgtgaacggatgtaacaatgcagggtggtcttggtctttggttgagtttctttttatttaaaagacattcattgggcatctactttgcacaaaaactctgcgctctgcccagagggcatgaataggtgagaggggtggagtctctgtccttacagaggcaaacattttgatgaggagataaacacacatggtgtgaaagagtgaatcaagtcaaagaaaagtacagagaatgtgagtgaggacacctggagctcaaaaccttgagcttttaccctggagtgtgagtgctgtgtgcttccccattattctggagtcaaggtttatgagaggaaaaggaattctactgggctttggagcaggaaggacattgtaggtaccagagtgagctagacatgaaatgtgttctcaaattggagacatatggaccctataaaaatattttgaccatctaaagttgacataaacttttttttaatcataaagctatttaaatacagacaaaactgaggataaatttcttaggattatggtatagcatatttataaattatatatatactaaaccatgaaactaagaacattcatgtttaatttaatttaatttgatttgatgggtgtttttctgaacctaaattgctaataatagacttaagaatgaagtttagacatcaatttgccaagtgttgttgaagtaaatggaagaactaaaattcttcaggttattggcctgcaaagtcctgttcttgctcatcaaggcaaggactagtaaaagaagcaactcctaaagtagaataggagaataatcctagtattaaggagtgtggcaaatctgttgcctcctgccatccttggcatgtgcctactagcaggtaagtcatggggctagtccacagaactagtgagataaaagctaaactcccaaatctgtgttacagcaaaggggggaggggaagctgattagcttaatgcaatcatgaacacatccaatattaatgtgggcttaaagaggtttgcagttaatattgcagaaatacatattgaaaaagaataatgaacctctaattacataaggcttgggtcttatttcttggaataacgaaaatgatcagatgaggatttttagtgaatattgactgggaacgtttacaaaataataacaaccattgtaatcattgtgagtgaaggctgtcttgaatccattgaaaaacaacatgaggctactttaaaaagttataagttatttacaacaatatttttctgctattgcacagaatgtcattgttcagaattttctacaggttgactttgacactaagacagataatggattttttacccttctgcctaaaacttttccgaccaataatcttaattgacctctactgtctacctcatggcaggaacctgtcaacattaagaaagaaatacaaggtttattatgattgccctcttaaaatcctgctgcaaaggacactatttttactttattgtttttcgtccgaatttctttgttttcctttcttagtaagaagggcagctagtcactctaatgttttgtggctgcctgaaaatgtactgtgagccatactgaggttatcataacttggataaaacattggcaatatcccctattcagctcttgaaggaagtgccttgttttatttgctaagggaagtctgaaaaagggaaaaacacagttctcacaaataaaacacagattgtacagatggtagtaaaatatgtcttcagtctacacaagaatcattttacctgcagcaggagaaacaagtaaggctgggagacatcataactgcagtggttgtaaaacaaggctgtctttggatttcattactaaagatgaaaataaaatcatagaggtgtaaaaattgagaaaactgtcaaaaagcaccccacacctctcatcttaaaatccatgatctccttagaaagttctttcatttcttcaaggaactgataaatcctagggcctataaactgttccagggcagaaagaaataagctttcctcttctaacctgatgtcagcttaaccctcttgccaacagggcaaccacaaatgggaaaactacccaatccaatccagcttgaaccataaaagcaaacgtctttaatacagtgtcagcagataaataggtgtgtatttttaaaagtaatattcaaaggtcaggttccaggaatgtaaggatggtttaacatgaaaaaatctattaatatagtatgctcttttaatagatcaaatgatgaaaaatcatatgattgtctttatacatcaaaagataatatttaacacatatgcaaggctaacaagtcttattaaaatagatggaaagatgccttgtagtaagatatgagataaaaaccacaatacattcatgttatatatatatgtctgtcacatgtgtgcatacatcatactccacatctctaagtcacatatgtcttatcactgcattgaaacaatagccaatgtcatgttcgatggtgcaatatgtgaatagaggacttttctcaacagcatctaacattgttctggaaatgctataataaaattaggaaaaaatcagaatcagagtgttatactgtggtaagacaaagacagtttatattttcagataatatgtttactaccaggaaaacccaacaaaatccagtggaaaaactcttagaaccaacagaaaaactaagtaagccatctggttacaatatgagcatacaaaaagcaataatgtttttacttataaattagtatatttcagacatatagaacaaaataagaaaaccatagaaacacttgtggacccactatccagtttaagaaattaaacattgccactgcagttgaagccctgcatgttcttctcctgatcacattcttcccttagaggtaaatccttattgtgaatttggtgttgatcattttcatgcactttttaatacattttaaaatatgagctaggcatggtggcttacacctgtaatcccagcattttggggggctgaggtggtaggatcacttgaggccaggagtttgagaccattcctggtgatatggtttggctgcgtctccacccaaatcacatcttgaattgtagctcccataattcccacaccttgtgggagggacctggtgggagataactgaatcatggaggcagtttcccccatactgttctcatggtagtgaataagtctcataagatgtgatggttttataaggggaaacccctcttgcttagctctcattccctcttgcctgcccccatgtaagaagtgtcttttgctttcttccatgattgtgaggcctccccagccacacggaactgtgagtccattaaacctctttttctttataaattacccattctcaggtatgtctttatcagtagcatgaaaacagactaatacacccggcaacatagcaaggccctgtctctacaaaaataaaaaagatacaaaaaacaaaattatccagaagtgatggagcacaactgggaggctgaggccagaggatcacttgagcccagaagttccgagttgcagtgagctatgatcatgccactgcattccagcctgggtgacagagtgagtccctatctcagaaaaacaataaataaaattttcaaaaatgtatgtcttcttaaatttcattggctgtttggctgctgtctcaaggaaatggcattctactggaagggttctttgttggcccacctgtttcaatcagcactgaatttgtgggattcacctgagtgggtgcgtggggctctagccatcattgccttactatgaattattatagtgcatgaatagagctctatttatcccattgtttgctgtcatgagcattcatatatatatctctttgtctcaagtgtttctccagatcccagggatctagagtacgtaccagggactgaagagaatcccatatcttctcttttccagacagaacccacagctctgaattcatgttccaaccagcagtgcacacaagctctcacagcctcacacccgcccccaaacacttgctcttgacaatcaacattttacgataccaacaataaatatgcagaaagtataatgaaaatagaagattccatttgcaaatgcagtgataaaagttttagaaataaaattagcaaatgtggtatagaatttatgtgaagaaaacaaaaacttttctttaaagactataaacaaagacttgaggaaataaaaagtgatacattttccttaggtacaaagactctaaattgaaaatataaaattttaaatcttatcttaaacaatcatggctactttcccatatacatatttttttctgttgcacttttcataagtataacagagaaaaaatatatatgggaaagtagccatgactgttaaagaaatgggaaagagggtgaaacaagtacaaccagatactaagttattttattacacactcaaaacagtacagtgctcatgcaagaaaatgagactggccactgaaaccaagtgtggtggctctcacctgtagtcacagctactggggaggctgaggagggaggatttcttgcacccaggtgtttgaggcaagcctgggcaacatagtgagatgccccatctctaaaaacaaacaaaaaaaaaagattgattactgaagtggtcactctagaaaaaacctcaagtataaaataaatttaaaaagtggcgtctcaaatcattgggaaaaagatatattttataaatgtattgggtttttggctaataacttagaaaaaaacaaatctgaattcttaccttacgatgtatacacacaaaattcagggtaattaaatactttaatttaaaaaataaaattaaaatgattgaataaacttctcagtgattttgtctatgatattgggcacaaaaccagaaaccaccacggagagatttgactacaccaaaatgcaaatctttggttcaatgacaaaatctatacatataaagaaaaataaactagaaaaaatattataaggatagtctagacataagagtttctatcaatataagaaaaagacatatctcaatagaaaaacaagtacacaaacaagcaatttgtaaaagaagaaatataacaccatcagtaattaaaatgcatattaaagcaataataagatacccaggatggctggattgtggtaaataagcaataacaaatcatgacacatttttggagggaaatttgtatatatttcaaaagtcaaattgtacataacttttgacccagaaactctatttctagaaattcatcaccagggaaatagagacagggaaaaatgtgtgggcagcagcgggtggtataagagtccgcacaggaaaccagataagcctgggtctgaatctcagcccagtgactttctaagccttggccttctcataagtataacaaaataattaatcacgcctcttagagttgttgtgggaattaaatgaagcaatgtgctttgagtgcttaacaaaacacctgacatattataagtactctaaattttcactactatcattgtcattactattaaggtctatctatagataggcacattgcattaatagtaatgacaatgacagtagtgaaattgtcattactattaagtaatacagccctttagtcattgaaatgatgatgcaaaatcaagtctactgacacagcaagatgcctaagatatagtattaaatgaaaatgcaattgatatacagcattttaatataattatatttctgagctctctctctctatatatatatatgtatgtatactcttgctacctcaggatcaagagtgctggccagtagctacttaatgtaaatctgtgtaagtggtcacataagttctgtagttaaaaaaagaaagtaaagaagaaagaaatgtttatcttgaagatttaaataaaatcttttgagaaattttatattttatccttagcaaactttaagattatgactaagtactaattattaaaataaatgcataataaactctgttgatcaatttttgatatattttttcttctaaaatgtgtatgaacaactattaagcacctacggtgtgcaggcactttgcagatactgaggacagcaaagaatgaacaaaataaatgcttacccatgtggagctcagtttctagaggggaagacagatgaagcaaatcagcagacgtaagtgcttgaggcactgtagatgtaggtgaagaatattgagagctggtgggaagggacacgctctctgaaggggaagcagagggaggacctttgggaagtgggtatggatccctaggggaagagagctctaggcaagggaacaagtggtgcaaagaccatgagctagggtcatgcctgacgtgcttcaggaacagcagtagggcccataaggctggaccagatctgcggagacagacaggaacacgtgcagcaaactgaggaggagcctgcaaggaaaggaaagtcaagaggattggtcacctggacaccaagtgaaagaagcgtttcaggaagcagagagataacttagtgctgagaggtcaaatcctcaagaactgagaaaaaccattgcattggcaacctggaggtcactggacaagggcagcttccctggagaggtggcaaagaaagcattcttgcagtgagagaggacttggcgacaagagcagataattcatttaatgagttttcccatcaagaggagcagaaagatgagaaagaagttagggatcagagtgggttaagaaaagggttcttatttggctattggagaaatggcagcctgtttgagtgacagtgaagggaatgatctggtagagaaggaaatggacgaagtcagaagagaacagggctggagtcaggcccaggagcagtgagagggatcagatccagggcccgatgtcagctggccttggcatcaacagttcacctacctaccacattcctccccaccctggctttacaacaggtgataaaataggcccccaaaaggcccccctggggcacccaaaaaactttcattgcccaggccacaccacggatcattcaaataagtgcattgccttaatgaaggtcatcttttgacaaatttccagttttcctttagtgtcaatttatattttatttgactctgtcaccatcagtgagagactacctagctacgattctcaatttatggatagcgttcactggggagggaggctcagtgagcatccgtctctctctccccttctttcttataactatgatttactaacataaaagtttctaacacgtggcagacatttaatacatttactaaatcaaaataaaacaaataaaaaaatggttggaaacagctaaacttaaaaggacacttctctccccttccaggcatccatggatgtgtcccaaaccaaagtgatggaaataaaccagatttcaaacttgggatattcctgatgattccagggaagataacaaaacccagactttggcatcagtttttagttctggagtccaaggtcaaggcaccaatagattcagtgtctggggcgggcccattcctcatagacaatggcttctatgtgtcctcatgtggcggaaagcagtgatcatttgcatacttaatgcccagatattttcacatggtagaaagcagtgatcatttgcatacttaatgcccagatatttttcacatggtagaaaacagtgatagtgggcatttcctttgctgattttgttgttcttgctagttataatatttgctttcttttaaaatgttgattataagcactcagataataaactagcaaaaaatatataggaagtctagaaggcaatatactacattaacttttttatttagccttaaaaagaaaggaatttctgatatatgctacaatgtggataaactttgaggatattatattagatgaaatgagccagtcacaaaaagaaaaataccagatgattccatctatgtgaagtatccagagtggtcaaactcatagaaacagaaaggaaaattgtggttgccagagactagggggagagagaaatggggattgtgtttaatgggtgcagagtttcagatttaaggcgagaaagtgctggagattggttgcccagcaatgtgaatacactcaatactacttaacacttaaaatgggttaggataaattttatgtgtattttatcactataaaaaattttaaaaagaaagaaggaaaatatgagataaagagagaagaaagagaaagaaagaaaaaagagagagagaaaaaaagaaagaaagagagaaaggaagggagggagagcaggaaagaaaaggaaggaaggaaggaaagaaggaaggaaggaagtgagggaaagaaggaaggaagggagggagggaaggaaagaagggagggagggagggaaggaaaagagggagggagggaggaaggaaggaaggaaggaaggaaggaaggagactgttaccaggctttgtttcagggctgtaagagcttgaagattgcgtggacattggaatgagggaataccatgtcctctgaaagtcatgtttagctctctggatctgtaaaacgttaggattccttcctcacacttgcaaaaaatttaattattgaaaaagggttttataacatgatttgtagcctctgttttgggtttagaccaagagtactatgaaagcctcatataaatacaagttttaacattttggctagttgagtctgaggaaaaaaatgaattttttggattcactttcaatacaatctatttttccagtctctagtttacagtgtgattcatttcaaaagggatctatttaaggcaatggggctttaagcaggacttgcataaaatgaagccgctgcttctaattcatcattcaggaacccaaactttgtaattatgtggccaaccatttccaatcatgactcagccggtcgtgaatctaaatagaatggctcacccactgcaattacgtaagttccccttatcaggcaggttgacagtcctcattgctggctttctgtcaacttttacaggagacttctctttgagatgtgcagctgtacctccaggctccccagtcagcttgataactccggcaaggacaggggggtcacctgaggactggaatcctgggggtctcttcatctaggcatgaggatgagactccaactgctccatccccctcacaccccatcatgatacttgaagtatagacattattcagccactgctttttgatctcaagaggccacatcttcagtgtggtatatatctgaattacgtactagtcactcctcttgtgcattataggttcgtggcttttaaaaaaattcagtcactggaacttcagaagtaatacgtgctgctggtaaaaatccaaacactgccggagaatctaaagtcaaatttaaaatgctcccttccctccttctaagtctacccctaatgaggcattttggtatattttcttccatactcttttcttttcttaggaatgtatgcatgcatgaatgtgtgtatgcatgtgaatgtatcatgcatgactgtgtataagcatgtatgcatgtgcgtatgcatgcatgaatgtgtgtatgcacgtatgcatgggaatgtatgcatgcatgtgtgtgtatgcacgtgtgcatgtgtgtatgcatgtgaatgtatgcatgcatgtgtatgcatatctattctttttaggtcaaccgtatcatactaaacactgtattcattaatttgatgtttttcactcagccattttataggcatctttcaaatatattttgtcaacctcattcttacaaattgccgaatagcacatggcactcagtcatccaggatatgcaggcagtttgccatttcagaccaagctgtgacaatcacttatttgcctacattcctgagcattgattcttttatttctaacagatgatgtccagaagtggtaatgctagtcccaataatatatgcatttttttttttacctttacagatgacactttcatgttctttttgaacttttttcctttttggcaaatgtagtgatcttgatatgggcaaatataggaaaattgagggcatttgtgggagtagaatctctttcgacccaaactaattgatatatgttcccaaacacgatgctaaggtttaagaaaatgcaagctatttaagacatgattaatctgcacgtacctctaagtttcctgattcactgtatgatgtaactgctaaactgcaagaactctttactgagagtttagagaggtaaagaaagacaagcactgcgtgggtaggtgctgataataatgatgaagacgatggtaacagtaacagcctcggctgaccttcatccaagatgcgcttggctgcttatggctggtgttcattctgaccagtcagtgcctatgctaatctggttgtaaaatatgtttaatatcaccgctgaaaataataccttccatttattttaactgagcacaatgatctcttttaagactcacaattctagatggaagctatggttatcacctccatcacctcaaggaaaccgaggctcagagatcaatgtgctcaaagcaagcagctaggaggtaatggggctgggatttgagcctgggctggctggccatatgctattgcttgctgcagtggcatctgtgttggtgtaggcagaaaagactccacagtgcaaggtgacttagagaaagtattgacaatctaataggacaccaggaggagaggagagcatcctaggcatggtctgggcaaagcccctgagctgggaatgagagagtgctggccactgatttccttctgtctgaagacaactgtgggctcttggggattttgcccaaaccttcctccccagtcttgtcactccccattgttcttggcgttctgtgttcagcccagttggactgtagaactcactactctacaaacaggctttgacacttgttataagtcaccctggctctctttcctaatctgtgtctgcccacgttggtcacccttctaagcatattcaatccatcatacccctcacagaatcaccttcatccttcaaggccagaaaggtggtccctcgcggagctctcttggtctgatgtttgcacctctcctaaagcgcaattattttaaatcttagagctattcatgggcatggtttttggcacttactctactgtaggctctgtcactattctaggaacactcatagtaggtagcacctagcacgcactgcacacgcacaataacaaacagtctgaatattttagagtcaagaaaaaggttttcaaaggaaatcttgggcatcaaatgaaggattgaggcccaaaatcttattacccatatgataattattggaaatcattgtttatcttgacacaagtttgataggtgcatgctttggtgagattgagtgaggcacagggcgaattcaaagacagaattctattgcttcactaaagtggagtaatgggatggagaagaatgttatatactgctgggaagtatttagaggatatatggtttggagacagaatatatggttaatgaggaaagttgggcagagagatggcctcaaggcaggaggtgcagcagaatcaaaggctggattcagaagtgggctggaaagaaaagggaggatggaggcaaaggcagcttgaaggatctcagactagagatgttgggtttagagaaaggaggaagattaacaactgaatttcctaatttttgtgcttttaaagctctggctgccccccacttggcattgtgcaaagacgtataaagttacacatctctggaaagttccttttggacaaagtttgtgaaaaatacattattattatgttaaaatcacacatatattagaagcaggaaatgttaatataaaaaagtaaactaccaacaatttcattttagagttgggtttttctgtgttccaaactcagactacccaggctataaactcactgtatctgctgtaaggacctagtgggggcagtgtttgagaaacgctatgctgaggtcaagatgctgctgagaggtcaggtgaacatgtccagagtcagggaaatatgggaggtagcaagaggccgcctgtacaagcccctttcccaaggcggggggcagaagagacttccccaaataaaatccccacatgctgtgcctgtctagacatcagtatctcggagaacttgagcacaccattttttttttttttttgagtttccccaagtctcatcttgctaggaaaggaggtctaattccttctacaattcgtcacgtttattcctaatgcattcagtcattcaacagatatttatttaattcctgatgcgtctggcatggtctgaatggcgtctttaacttgcttactttcttctgaaagtctcttatcatctctatattgctcataaaacgaggacctcgaccaggtgcggtggctcacgcctgtaatcctaacactttgggaggccgaggcgggcggatcacgcggtcaggagatcgagaccattctggctaacagggtgaaaccccatctctactaaaaatacaaaaaattagccgggcgttgtggcgggcgcctgtagtcccagctactcgggagactgagacaggagaatggcgtgaacctgggaggcggagcttgcagtgagccgagattgcgccactgcacttcagccggggcgacagagcaagactccgtctcaaaaaataaaaaataaaataaaaataaaataaaataaaataaaaataaaaataataaaataaaaataacaataaaataaaataaagcgaggacctcaaagggcactgagtcatcagctgtagtttggtcacgtcacattagaaatgaactctccctttccttgttcaggatgtaggacttcatccgggaaggctaaggctgtattggcctgcagggaaccccctctcactatgtacttactgtagatttgaaatcccagattattttcctgctactcctgcagactcatatcttcctatccatacctactcttttggagagttggagctctgatttacccacatagaggttcatcccgctagtccaggctgtggttaagattgcggtttcttcctgatgtgatcccttggatcctgacggggatatgagatgtatttgttcacaccacgggctgctgagctggccttgcacctccacatccctggacaggcttggtgaaagacagtgggtaagatgaacagggagcatagtcagatttatcttctttctcctaaactttaactctctataggaaactttgcttttcagtgaacttagaacacaactattacaaacagattctgtgtattctactagtaacaatgggaatggttaaaagtgctgctagcaaaaagtatgcagtgagctcactgtgaatttttatggggacagtgacttctttttaaaaaccaactaatttttaattgacaataaaacattatataaattgatggtatacaatataatgttttgatatctgcatacattgtggactggctaactcaagttagttaacatatatggattacctcacatttttctgtggagagaacacttaaaattgactctcttagcaattttcaagtatatattgctagtaactatagtccccgtgttgtacaatagacgtcttgaatggattcctcctctaactaaagttttgtgtctttctccctactccccctgctccccaacctctgcaacccccattttcctgtttctatgggtttgccttttttaagagacaatgactttctgttaaggctgtagatacaacactggtgaaatgtgttatttcacaaatgactgactctaacgtgtgtgtgtgtgtgtgtaaataaataaaatttgattttttatctgagcaaatttttgttcattacccaaaagaggagttttttaggttcagggagagcaaaataaagttccttgatatgttaatttatagttcctctctgtctttgctcctggccttcaggagggtgtcagtaaatggcagccaatgaattgccagacaatcctgccttccaatgctgggagactggcatagcaggaatggcagcaggtaaagggaccgtcaggaagctggtggatcctggacaaacatacccgagactcagtttccccagtggcctccttgtctatgtcataatgttgtagtgagaagcaaataacacattcagtgtgaaagtactttacaaactggaacctgctgttcaaatgtcaagcgttatcatttagtaactccaggattacccaaatttacactgagacatcacccctcacatgattaacaccttggttcacacaagagcactttaaatggttgataggttcaggtcaggtaatacagaagaagaaaaattcaaatagagaacaaaaagaaattggtcattgaaaaaaacaaaattacagtgtttgaacgtagagatgagccagccataagaagcccttggattagtaagtttatggtgtcaggaaattgactgctggaaggtgttttcaatgatatttcattgagacaaagaggaagagcattgttagtcaggacatagctaggcttgatagtttccttcctgatgctgaaatagactctactgttttctctttgctttgtacttgttggtgtatcgtccccaaagctcactaatttagttcactctttcactatgtgtccctgaaacatctacacagaccttcaacaaccaaagcgcttgcacagcaaaggagtcggatgaaaggggataagcagagggtcaatgtaaacaagggcagagagccgaagccaccacctaaaaactgatcagagccacaggagtggtcaccggcaggccactggcaccagttttctttcagtgtttgctcagatggcatgcagtgattgtctgttcctgtacctattctctttgattctctagaccctgagtccatgaggaaggcacaggaaaagcacatatccaatccaaacagtgaaaggtgtcatttaggcgtgtttctcccctctttaacttcagggagaatggaagaaaagtgggacagattgaatgataaatatactcacaaagtaaatgactttctcaggacacatatcatatttggacaagttttgttggccccaagctaaatgacagcataaggatctcattgtgtttttcattttattgactttaattggctcacaagtttgacaatttactgctgtaatcagtattattttttaaagccaatagtcttaacagttaagtttgcccaaactcacccagctcaacttcacaaattttaagatacaagcatatatattttttgacagtttctagtaccaagtccacagtgtggccataataagatatagtagagcaataacatataaaaaggttctttataaatggagctttcagaagttcataaaacagttgaaaatgagccaaaagtttttacactatggagaaagtgagagattgctcaaaaaatgcatttcagcataaattggtggacgtaaatgagtggaccacaaaatcttagtcatttgtcctatttgcaaaggggctataatttgtctgctagttattttaatgaatatcctttgtatttgcttggatttctggtttcctccccaatctgtgtgcagatgacggtatttttaaagtaaaggcccatgtataaaaggtgcagtggttaaatgtgggaaaggccatctcagtcttccaaccctttctctttacccacaactccaaatcttagatttgaaggtgcctctggtggtaactcagaacctacagaaatcgtagagacatttaaaggagctcttcttgaccagggaggtgcctggctttctgggcagctacttgagttcccaaagacatcattgaaatatttggaaatgcccctgccaaaatatcccagccatctgatttggcctaagcaatgtatagtttctgtattttagtttagtttcaattcagtacttagttgtttccttgcttgggaagaattctagaagaggcaattgtccatcgttggctggttttacttccctttgtttttgaaaggctctgtttttttttttatgtgggatcaaaataatattaggaggtaaatttggaggatgacatttctttagatgatgtgaaaaacaattcagccttaccactttcatgtgctagtagggctgacatagagagtggaaagaaaatgtcatagacatctcctatacaagaagtaatctgatcattggcaaacatgacaggttgctgagaggagagcgagccttctttcaaatgcttgcagatgctcactggaaagagatgacggcagagttaagcttcctttgcctgtactctatttcatgtcgtgttattaatacattgtcttccaaggggaccaaatgagacctactagtcttactctgaactggagtctagctttacatccttgtctggaataagggctgataaacaaaaacatgtgtaatctgcttttctggggaccctagaagagagagaggtgtgtgcttctctgaggacaagagaaggaatgagcacagtctctgaagagacagaactcttaggatttatcatggtgtgggatcagccacatttttatcaactcaaagatctcaattaggttagctgatgaggaaaagatactttctgcacagctgtttgatttttcatcatttgacaagacctgcaaaaaattacttttatcaatatacaaggagcatatagtagctcgttgttcagctgaagtggccagtggccaacatggtgaggcgtgaggcatcctcctgatcccaagcctcctgtctggcccagaacagctctgcaattaccctcgttctcactcccttgggataagtagtgatttccaaaccctggctatacttagagtcatctggaggggatttaaaaaaaatactgatatctgggttccactccagacctacaaaatcagaatatttatgggtggggcctgggcatttggtattttttaaagtgctccaggtgattctagtgttcaggtaccagagaactagagggcgaggactattcagtgactccatctcttctgttaaacagagaggttttctggcagagggaacacatgacatcaccataagtcatcaagaccatttacaccggccgggcacagtggctcatgcctgtaatcccagcactttgggaggccaaggcagtcagatcacctgaggtcaggagttcgagaccagcctggccaacatggtgaaacccccatctctactaaaaatacaaaaattagccacgcagtggtgcatgcctgtaatcccagctgcttgggaggctgaggcaggagaattgcttgacccaggaggcagaggttgcagtgagccgaggttgtgccattgcactccagtctgggcaacaagaatgaaactctgacacacacacacaaatttacacctttgctggaagcatctggcaggagatgagtctagtgttggaataggtgggttgacactgatgagaagtgaggaggaaaatgccaatgactctgggatgtcagagggcctagaaaactaaggtgaaaatcatgccaaaggaggtttgaaaaaagagaatgagaaggcacaggaagacaaaattaatttagtttccaattttgccagggccaatcaattactggaacagcaggtggtgggtgagggatgcagagaagggaattaacttagaactttccagtttggaggtcagatggtgtaattcattatggaagctgaaaaggacatgggcaaatttttaccctcaaaatatttttggctgcaggcacaccgcccggggaaaccccccaggatctttatgttcaagggaatgagcagtcattattagtctgctgtagtccaggaccaagaattcccttttggaacgtggctctcaattttacacttttgtgtagctaactcaacctttccatgagtaattcaatgcaggttgacaatttatttcctaaaatataacagtgccccattgtcatgcccggttgaagtgagggtctctgtggatcctgctaatagttgaaaaatcacaaacagccatcgtaagcagcatgaggcaaaaagcaaaaaccaaaagtgtctctcctgatgagaaatttttggaagtcagggctgtgcatgtcaatagtatggttgttggtagaaaaattttctttagttaatataaactcaattagtccttggttttaatttgcttttatttatttttatcaaaatataggttaggccatggaaaacagtgatttaaagatgtatttttcatcacctgagcccaagaagttgaggctgcagtgagttgtcgagtgacactgcactccagcatgggtgacagagtgagaccctgtctcaaaaacaaaaagatgatgcatgtaaaagaaattaccatctctgaaatctgaatgtcttaaaataggtagggttttatattaggagaaataaggttgctctcccaggctttaccaatctcctctttcctccatgttcacgacccattatttccaaaagctgtgacatttcctgtatattggcttatccctcatggcagcgtttctcagatgcatgaatgcttgactctactcctcagagaatagcagctgcctggggtcctgggctttgtctagatatactccctatcactcagtctttaaaccaagtgccactgaggagactccctggatgttcccaggtaacatcagggagagaactgaatggctttgtcatggaaattctcctcaaagcatgtggttgacctatttttgtattccagaaacacttttctatgcttcagttcaaaagcttagaattctgttaatgctcagcttgtagctctaacagctctaacaggcttacttgggaaaactccccccgaagcagaaatccttccccagcatctgtcatcaccagcttctgcttggtcctcatgatgggaacctgatgcttgctgagacagtctgtccactatttgatagaaagttctgcctaagaaaattcccacaatattcagtccaagaggaccccaactgatcccgagttcttcaggctcccaggggccattcctgcttgcagtaagcgaatgcccagaatccaaggctccatctcgcatgactgcaagagtctagtcccttcccgaggaatcccgggagtgctcacctgttgccttccctcctcactcctgctccacatgcctactttcagatatatttgccatagtccatgcaccatcttggtgcacttctccgtgctggtggagctctcatggtctcataactcctcatgtctgaactcacacttgactcctctcttaatccccaaggcatagcaccatcgacacagtggtgtttaaaataccttaatgaagatctgacagtaatgtaagggaattagcattcaggaaaggacaactttaatttgaaggcagtggctcatgacaccccatcaggcccatgtggctgtctccctccttaggctgtgtgtgcgaacattttgctgggcccatctttcctatttagcatccactttgtcatttcctcttctccagcaagtcccaggggctccagttacccctctctgccgttccacccatctccattataaaaaaatctctcaaagatgcccatgatgaaaatagccttttctattaatgtgatgaaaatttaacatctcagttttaagcatttacattgggaatacttcccaaagttcaaggacaacaaaaagcttcttgttttaaaactttcagaatgtaattactcacaaaagtgaaatagagtctttcccaagggcaaactcaccctttacctttagaggcatagggcatatatttctggcattctaacaaatagcagtttgttcccaattcagactgtcaaaagtttggaaacactgtggttcagtcacagagcctgctactatgaagtttacaaatgcataccaactacaggtgtgtgaacatacaggttgcacaggcaaatgaagacataaaacaagtgtaatgccattgcggcgaaatttggagtgcatactgtctaacatttccttttacaatatctaaaaattaaatattacattaaaatgaaaggaaactcattttaacctgaaatcttcccaatatttgcttcctctgattctagttttttcctatgaaattaggattagaacaaatctaatctcttcaacatcattcaaatatgaagaatgcactcttgtctcatcaagtcttcccaaaatttttaaaaagaaatttaaccttatgctgtcatgtaggtttagcatgagatgtagtatttaatatcttgatcattaattaagaaaatggaaccagaaaccagagcaaaaaagctgaaaattctaaaaaccagagtgcctcttctcctccaaaggattgtagctcctcgccagcaatagaacaaagctggacagagaatgactttgatgagctgacagaagtaggcttcagaaggtcggtaataacaaacttctccgagctaaaggaggatattcaaacccattgcaaggctgctaaaaaccttgaaaaaagattagacaaatggctaactagaataaacagtgtagagaagaccttaaatgacctgatggggctgaaaaccatggcatgagaactacatgctttggaagaacattccatgctcatggataggaagaatcaataccatgaaaatggccatactgcccaaagtaatttatagattcaatgccatccccatcaagctaccaatgacttttttcacagaattggaaaaaactactttaaagttcatatggaatcagaaaagagcccacattgccaagtcaatcctaagcaaaaaagaacaaagctggaggcatcacactacctgacttcaaactatactacaaggctacagtaatcaaaacagcatggtacttgtaccaaaacagagatatagaccaatggaacagaatagaggcctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttacaccttacacaaaaattaattcaagatggattaaagacttaaatgttagacctaaaacataaaaaccctagaagaacacctaggcaataccattcaggacataggcatgggcaagtacttcatgactaaaacaccaaaagcaatggaaacaaaagccaaaattgacaaatggggtctaattaaactaaagagcttctgcacagccaaagaaactatcatcagagtgaacaggcaacctacagaatgggagaaaatttttgcaatctactcatctgacaaagggctaatatccagaatttacaaagaacttaaacaaatttacaagaaaaaatcaaacaaccccatcaaaaagtgggcaaaggatatggacatttctcaaaagatgacatttatgcacccaacagacacatgaaaaaatgctcatcatcactgatcatcagagaaatgcaaatcaaaaccacaatgagataccatctcacaccagttagaatggcaatcaataaaaagtcaggaaacaacagatgctggagaggatgtggagaaataggaatgttttacactgttggtgggagtgtaaactagttcaaccattgtggaagacagtgtggtgattccttaaggatctagacttagaaataccatttgacccagcgatcccattactgggtatatacccaaaggattataaatcatgccactataaagacacatgcacacgtatgtttattgtggcactattcacaatagcaaagacttggaaccaacccaaatgtccatcaatgatagactggattaagaaaatgtggcacatatacaccacggaatactatgcagctataaaaaagaatcagttcatgtcctttgcagggccatgaatgaagctggaaaccatcattctcagcaaactaccacaaggacagaacaccaaacactgcatgttctcactcataggtaggaattgaacaatgagaacacttggacacagggtggggaacatcacacactggggcctgttgtgggttgggggcaggcggagggatagcactgggaaaaatacctaatgtaaatgatgggttgatgggtgcagcaggccaacatggcacacgtatacctatgtaacgagcctgcacattgtgcacatgtaccctagaacgtaaagtataaaaaaaaaggaaaagaaaactgaagtaggccaaattaggatttgaggataatcagagccttcaagttggggtcatccattctagcctccagtttattgatatttctttcacagtgtccttgaaaataggatgttttgttaaaaaaatttaaagatatattttcagaataattccattgtaatctgtaatgcagtggcagatatctcaagtaaatggaggtcaaatgtttaaaaacacagtgtcatttgaaaagatgctgaagttcatttactgatataaatgatcaaaatggcaattttacagtgttggtcctttaaccttaatttgaggaaatggaagaataaatttgtgttgtccatagtaggtaccacccttttatccttaaatgctgacaaaggaaaaaagtgatacctgaagtatagcttagtaaaagttattgtaggatttcatattatttttaagtacttgtaatttgtaagtaaaagattttgatttttcttaccttcaaaaaagcatgtaactccatcaatcaggtaaatacacaatatagagtgatggcatggattatttatacatttgctgcttaatttcttaaattacagaattttgtaattattttttgttatttatttctagctaaatttcactggagccagagacaatatgttgtataagtctgatgttttgaattgtgttgagatgctctttgtgaaatagcatatggacatttttgttaaatgtttctcatgcatataaaacattgcgggctctgcagttgccaagtgtacaattctttacatggcaattgcttcatgttaattatgttgtcccaatcttttttattctttttttcctctgtgtgtgctaccagtcactgagaaatgttaaaatctctcactataattgcacatttgtctatttttccctttagttctgtcaatttttgatttatatattttgaagctgtgttatcaggtgcatataccacttgttatatcttcctggtggattgaccttttaatttttctttataaaatatttctctttctctctagtaatgcttctcgtcttaaagactgctttgatattaataaagctacaccagctttctttcagtcagcatttataatatggtatgtttttcccattcttttctgccaactgttgggagtttctaaataattaggctttgttttcttctaagtcttagaatgtttttttcattaaagcatttgttttttcacatttaatataattactgatacatttgggcttatagttaccatcttatatttgcattagctggtttttttttgttctttattttagaattttcaagtttttttctaactattccatgatctcctctattaattttctttttattttctacttcctactttttaaaaatacttagagattacaaggtgcatccttagtttaaggtctaaaataacttactagtactaagttattacatcagtctacttcttggacaatgcaaacacattagaaaacattaacttttaacatttaccacataatgtcttgtgtattattctgataaattttaatttcacacatcttaaatgtttttaagatgtgattattgttttctacaattattattcattgggatttattcacattttaaaaaatatatatatttttatttctcccacatatccatgcttttggctaagatcatatttcttctgcctgaaaaactcctgttaggttaatacaggtttgttggtgaaaaatctttatcttagcctaacttttcaaagatactttccctgagtgttgagttctatgttggcagttattttccttcattatgtttaaatatgtcactacatggttgcttggcttcagtcgagtctattaaaaagtcaactgtccatcttcttgttgctttccagaagataataggccttttccacactctggatgcttttaagattttctcagtctttgattttcagctgaaatgtgcttacgtgtaattttctttgtatttatattacttgagtttgtaacacttttaaaacctgtagtctgattttttaatcaattaaaaaaatctcagccattatttcttcaattacttctgttctactccgtctgcaccatttctgagactcatacaatacacacacaattcaattacacatatgttagacatttttaccatgccctacagttctcatgtctcatgctcttgtttacttgtttccttttctttctgtgcttcggtatggatattctttaatgacataccttccaaatcattaatcctctttttagtggtgtctaatatcctttgaaacacatctcttttagttattgtacttttcagttttagaatttccatttgatggtattttaatagatttcagttctctagtaaaattctctattttgtcttaaagtctgtcaataacagcgagagtccagtctctaaactctttttaacttagatcacctggggtgtgtttttattgtcttttcttctttttcctgtctcttatatgtcctgtctcttgatatacctgctaacttttcattgaatgctgtaaattgacacacattcactcatattctaagaaattgtagaggctctggatgattttaccttccaacaaggattttctttaactcttgatatggagttaggagcagataacctttatccaactgaagatgacactgattacagtctaattttcagtctatcaaaggtctagtctgtttccagtttacctttattcctagagtgtagtccttcaggggtcccaactgcaaactggaatattttccaggagctctccactttggttggcatccaatcccaatttttgtttccccaacagtgtaaagatgactgtagctctgcttagtttcttagccttctgcgcgcttttttttggtctcaatttccacacagtttttggactgcatatcttaagagaatgctttgaggaagtgacttaaactatcgaattttgttgtcttcacttttcttcacttgaggatcttggtatctcaagtcctgactactttggcaggcctgtatgtctaatctttctctcttctcttgtatctgcatatcaattgctgggcttagggcccaccttaaatacaggataatctcattctgagatctttaacttaattacatctgcaaggactctatttcccagtaaagtcacattgacaagtactggggtttggaacttaagtatgtctttgggggacagtattcaaactgtaaacacacacaaaagcttagaaaatatagaagagctatgtcaacaaatgttgccatcctgagctaaattggagaaacagggtaaatgtctaggaataacatcctccctgagttgtccacagaaacttgaatgttttgataggaaatgcactgggcagtattttatttcttaccaagcttagcttaactaagaggttggactcatgttagcaggaagggtttcttcagcctcatctacagcaggcagaggtcaatgctcacagggatatggcttcactgcctgctgcacagagcagttatttcctccacaaaggaaatgcactggcaagccccaggccatggctagaaggatttgaataatcaattggataggatgactggttctgtggacagcactcagcctctttccccagccacctgtcattgcccatgggcccatgaacaaaatggccatggtggcagggatggaggttacgcatgggctcagcaacatggacttctactcaccaaggctgacctggctacagccactgctgggagcccaatttgccagcagcagagaccaacactgagcccttgatttggcaccatttcttggggtgatcagccagctacctggtggcaggttgatgatatcggacctcttccaccatggaaagggcagaggtttgtcctcaatggaatagacacttactctggatatgggtttgcttatcctgcatgcaatgcttctgccaaggctaccatccgtggactcatggaatgccttatccactgtcatggtattccacacagtattggttctgaccaaggcattcactttacagctaaagaagtgtgacaggggacatatgctcatggaattaactggtcttaccatgttccctatcatctgaaaaaggttccctgctcctccatctaagcacgtaggttccacttgtggctgcaagcttggttcgtgtgggcatgctcaggttatatgacctttaaactaggggcccatggtaactgaaaaacaacccacaaccttgttacataaaaggagaaccagattggtctggtgcagttacacatgtaatgattgaagctgtgttattaataaaatgcttagaatgaatgattatctagacggaattagaatggaggacacagggacagctttataccattcagaggtgtctccattggtagagtctggagatggcagcacatgtctacccaaaagggaaatttcagatcacagcctgtcaacatccagactcctggggtctgggaaatgtgagagaacacatgaatatccaatgagccacaggttctctgccccaggtccccattcacatttcatcttgatctaacttcatcccagtttcgtattttccccaacaggctaagctactttttcttcttttctctcctccttttcccccttgtcttccattccttcatctctgtttcctaatctttgcttgatgccattatcgcttcccgttcacaaaagcagtctccactctagggggtgtaggtggaggggtcaattaaggctgcactgatcaccacattcaacgagttccatcaagtggcatccccttttcagaactgttcacttaaaccgatggttctcacacgggagtgtacgtcagcatcctccaaagggcttatgaaagcgcataattctggttcagtaggtttggggtggggctggagaatttattttttaaacgggttttcaggtgattttaattctgttgacctgctcaatacattttgaaaaacagttaaacctgcatttgggaggcagactatttccattttcatggatgtattatcatttagagacccacattctcttcctactaacacagctggggcagtgtggtcaggctgggaagcgtgggagcagaaatatttgttatttgttctgaaaggctgaggggtagttttgtggtcaattctaagaggtgcctgggcttgctggaagcagcttttcccattccttttgggctgccaactggggactgttctcttagcccagagctttgtcaatgggaatgtttacctggtgcagatgggaaaaacttcattcagcctgcactgagtggggtcccttctgtgtaatgtatgatgtaggtttgggactggctttttggtttgatggccaggtttactaacattttgcccaaatctaattcaaagaaaacaaggtacgagaataaaattgtggagtaaggcatctcaacattactgtcttctcacttcagaccagttaatgagatgttgtaaaagtggctgagagaactaacatgtgacccactgattgtttcccgctgatctcctgcgtagcccatccttacttcctgctgtgcctgccacttgtgtagggaatcataacttacaataacccctttctctttcagggaacacaaaaaataattaagatctaacttattgttagatatctttgtgaacagatgagtcctttctattcctcttttatctccacacctctttctctgttccaaatttgggaagccctcagtttgatagacatcttgagtctgattgcctttcacctccctggggacagaattgaattgagcgagtgtgaggatgccagatggcagggtagggggctgccttctgatgagagcagggattgagggacagggctctcactaatggtgtacgatatgattatactcatgctccgatagaaccttcagtaaaacttcctcgttcactaatgccttgtgcaatccttttatgggggttgggggtatgagcactaagaactcttaagttggcatcagatgaccccatgggatgacagccacatctcacccacaaggtccacattcagctgtaggagttctcctgggcacagaccaatgctctaggttggcaatgctgacattatggggactcagtatttaggttttatcattcttgtgaaatatttcccttgtgtcttttctatttgtccatatttaaattcatgcagcagacatttattgaatccttgctgtgcattacatgctgaaggaacaagaaagataaaggtagctaatgtttatatttttctttagagcttaaaaatgctgttgcacttatcaatctcttggatccaatactgcctctgctctcaaattatgatgatatcataaatatgccttgtttaactgaagtcaggtgtttgagaaaaatgaaacagtattgagaggtacaggtgttaaccttacaataagagcaggattttaaaggaagagaagacaattcttaaaaatggcaagatggattagacttaatgcctcacatcaatgaagggatttcaagtgagtggctgtgtattttttaatagaccacaaaaaaaattctatgtagaaaactgaagaattaaaatggtcgacagctttccttgcctatttttgtccttttctaaatgtactccttatggagagaagagtcgtgatgacagcccacagaagtgacgagtgcttggggtcaaatgggtttgctttggggttgccaggaaagcttctgtttggatttgctgccatggcctgcagcaaaggaagcctgcaattttagctctggaaatagtattcagcttaaggtaagttaaaaaaaaaataagcacctgtctcttctgaagacatgttgtcttagacaaatcattcttgactttctagttgagatgggccttaggttgcctggaactacataaagatccttggcgttcattcttccattgaacctctcagaaaaaaaaagaatgtccattctgtgctacttagggcacaaaaaagataattttggtaatataaatgagatagaatataccatggcactacattataatgatactttcctggaatgatgatggtggtgattttgatttagaaatctgcatgagattctgatcccacattccaaggagagctttggaatggcttgggggccttgtattccccaagaaatcttcattacaatcagctctggcaatttatagaagacttcaaattctgagaactttagtctgttgaatataaaaaagaaggaacaaaatcaatcccttcgtggaggggctacatgtcatatttacgatgaaaaggaaatgccatttgtgcattttaggttgaactttagaattcttccagctccactatacgaggcaaaagaaataattggtttgtagccagtaataaaggcaatcagccataaggtttgctttgctaagttgtccctcctgtcacatatatgtgcagttacacaccaggaaagggacagtgccaggttcctcattagccactgtgtttgtttatgctggggaagaagctgaccacttacaaagagccagctgtgcatgagccggcctcaccgtggtgcccatgaaggctgcagcccctgcctgcacagaatctatggaacaatactgtttatctcacctaaattggttaattacacggtttcattctgtgtgataaattcaatgataggggaggggaagaagcacatgtgaggaacacctgctcctcctaggagtcagaggaacgaggttgctctgtgagcgtgccagcaccaggttggagggtgccctagacattgatctctacctctgaagccaccaggtggggtatggagtggctggtggggtggggtctgatcctctggccagagaaatctcagctggcctctcggttcccctcaatctattaattacttggtgccattcaaatatgatcatttctctggatgtcactacatgaacaatattgggaagcaccatgctggaagataggtccttagagaagatggctaatgcaaggcttccagttcaagaaagagaatcctaggcagaaactaagcatatgaaaaagatcagagataaccagtaccatgacagtcagggtgacagtgtttgattcagctggagagaaggcagaagggagaggcaaagggccaggaatggagggccttataaggccctttaacctccccctaaatctgagcagagccattgaaggactataagtgggctgatcattccatctgttctggttagaggaggctggagcattggaacctggcagcatgcaaactgagtgagcagcttgggattttttgcagggaaacctgatcaagggctcaaccaaggccataacaattgttaaagcaatcttttgcaaactgtgcagtgaatcacaaatgtggattttaaaataggcctgagcagactgcctgtatgaattgaagacaagttctgtaactaccagttagggcagctgaatagattattgattctttaatttcaggccacaaagaaatcattacatggagttatgagagtttaggttaaattaaaaaaaattaaatatttttagcagagtacattttgcttgcctagggagattgcttctccagagccacttagaaatgtcttatacaggtactatcatggtggctgggacagtcaaacaagaaggtcagagaaaaaaggaggtgccctcctgggtacttctagtcttaggggattttattcttagagtgtgatgttaatcttacaactggggatttgtgcatcagccaccaggcgccgtgttatttccccttcagtctctggtaaccaatgattctactatgaccgactgacattttcgcattctcactgagaccctggtgtgtggatgtgtgtaatggtgttacattaggactgttctagtacttttatgttttggatgttggggcatggattcagaatagtttatcctattctgagccatgctgtcgtggaatttgctgagctgcgatgggtgtcttaaatatatgagagtgaatctctagtttgttagcatttggagtttcctgaagtgtaaccagttatgttgcctaaacaaaaggggatgtttgggcttgactttgttagtagaaacactgcctaactgcaaaagtacctgcagggcatgacggcgtgttctcctctgaaggtctttaagaatagcatggattccgcctgggcgcggcagctcacgtcagtaatcccagcactctgggaggccgaggcgggtggatcacatgaggtcaggagtttgagactagcctggccaacatggtgaaaccccatctctactaaaaatacaaacattatccaggtgtggtgttgggcacctgtaatcccagctaaccggggggctgaggcaggagaatcgcttgaacccaggaggcagaggttgcagtgagccgagatcgcaccgctgtgctccagcctggcagcctgggcgagagagtgagactccgtctcaaaaacacaacaaaccaaaaaaagaataacagagtcaattcctttgctcacagtggctaaaacagttcctacctgaagaaaacagaagtggatctcatgacatcttgagtattttgcagtcccattatccatttcaaaaacgagccttttattcagcctaacactgcatctaatagaataagatttttgagagtgagcttttgaaattataatgttgggatgttgctagatgctctttgagtgatgagattttaattttgaaaaccagcagtgaaacactcaccaacatgttccttctagatgaagctgcaactgcaagacagttgttactctttcgataactcgaaggcagttttaattattaactaattagggtggaaacagaggcttgtcattttcattattctcatggcacacattgttaataattttctggcttttggcatagtgatatagggcacttcagttatggcttaaaaaaggggaggagggcacatcttggaggtggattaaataaagatttagcttctttgcctcaggattgatatgtgccattttaaagcaaggctcatgagatctctggatcgagaggtcagtactaaatacaggaatgaaaatgctgcaggctctggggaagggaggtggttagttctgccctgcctggggagaaggggttcatagcaagcaatttcacatgggctttgaagaagtcagaatcgggtaaggatggggtgtgggagagagaatatatgacaaagagaaccagagggaaaaggacatggatgtgaggctgtcgagcatttattcagtcaacaaatatttattgctgtctgctatatgccacatacattctaagccctgggcacagcagaaaattaaatgggcatgtttctactttcctggaggtcctagtcaattgacagtgctccaaggattgtaagcagcatggtaaagttggcgtcggacagggagcaggtgtcacagtgtccagtgtccagtggtgaaagaccatgcgatgctgggtcaaggaactcaggctctgctctctggtctcaaggcagcccctttgctaagtggctctatggctccagattttgtggtaggaggacctcagccacccctccaaatatacccagttatttctgggagcaagtcccttgacgtgcctctcgtgcatcgcacaggttttcaacaacagtcctcttgcagtcttcaccctgtctttcctttcctgccctggctgaggctcccagcttcccgcggtatggcccaggtttcaagtcccgagaaaaaccttatcacacgggcaccacctcataggaacaggagagatccttgagtaagtgaggagattttacgtcctaattggagtagtgattacatgagtgaatacttttgttggaaggtactatattgtatccttaaaatgggaacattttataaattattttatatcacaataaagttaattttaaaagaaaataaaaattgtgatgtccatctttttagtaacctcaaatctttttacttattaaggagatctataatttatttattgtttactatgtattgaatgctatgtgttttacattaattattccatatacctaggatgaaaatactactatcatacccaatttgtggctggggaaactgaggctcccagaggcaaagtaatgaaggagctaaactggtatccctgcagtaagggttggagacaggattggagcacagcctttctcaatccaagtccttgcccttatccattctgtgaagcagcctcttttgtcacaaaggttataattttacttcctcagtaaaataaaaaagaagtcacctgtttagcatctgagctttggggtgctggtgtgggggctcagagctttacgcagggtgccacgggagtggccagcacatctccagtcctgtttctcgattgccagcccttcctctcaagtaacaatgctggagtcagcaggcaggaggctgtgaacacagcacttaatgattcagtcctgttgctccctgagccagctggagaagcctggctcacacagcccgagagatctctcaggcatggagctcaggtaaccttctccacctacctcttttttttttttttttttagatggagtctctttctgtcacccaggctggagtgcagtggcgcaatctcggctcactgcaacctccacctcccgggttcatgccattctcctgcctcggcctcctgagtagctgggactacagacacccgccaccacgcctgactaagcttttgtatttttagtagagacagggtttcaccgtgttagccaggatggtctctatctcctgacctcgtgatccgcccgcctcggcctcccaaagtgctgggattacaggcctgatccaccgcgcccggcccttctctttccatttagcggcatcattcttcatctgtggccaatgctatcctagaccatcactcaaggtgaagccagggttggactgctgtgtttagagaagcctcaggttagtctttgtaggttttgttcactttatagatcacccagggagggcataagccagtgggccattctcacccctgaggacggaactagacccttggggaaatccacacctcccctgccccaactcctgtctctgagtccatctgtccccaggatggactagaggagaacagtgatgtcccgcagcctaaagactgaagcctctcccttgccccacgccccatgaggaatcaagggtcactctgaagagaaactgaattgaaactagttccagttattgaacacctgagctaatggactgaggtcatccatctctatgtacatagtagtctggagtgtgagttttggggatttgggtggaccatggagggccaggccttctacagggcattgtccttctacgttctgggagagaaagtgggagaggagggtgttggccccatgggcaggtcacaccatagactcttacatggctatttgcaatagctctgagccccactcagggcagagaggggatatctagaggtggctctgagagaagataaaaacttctttagcaaatttacttcttgagagagggaaaaggaggggcccagtgacctccaggttgtacaaggatattctcctgaacccatcagctttcctagcacctaaccaaatggagacacatagacataccccatgaatggggatctaggaggatttcagataatattcaaatgtcttttcaatggtctttctgcgtccaaactaatttcaattcaaaacacacactgcttcatgcatggtgagatagaactgcttctctcaggatgtcacctcactcaaactgttactgtctctcaaggcaacattaacataggaaaacccacagtactgacctccacaccctgtctcccaaccttacaatttgtatcacaaacagtgatggaagaagaaagagaataaagaataaattaaggggatagatgaatgtaaaagtgaagattagaaagatgaagtaaagaacagagaggtctttctggggatagagggaccccgaagaagaagagctgctggtttcagaagaacaaaattgtggtcacctcatctcaaaaagggtcacttatttcctttatgggtcccatatttcctttatgggtcccttcctgccaccccttctgtctgaaactcattttcgtgttatccttttgtccttccttctataaactaaaaataaagacccaagcaacaatgctccaccccccaccccacccactgactgggcccacttatggccaagaggaccccagaaaatccttaaaagtgagttccttgcttttacactgttggtgggagtgtaaattagttcaaccattgtggaacacagtgtggtgattcctcaaggatctaggaccagaaatactatttgacccagccatcccattactgggtatatacccaaaggattacaaatcgttctactataaagacacgtgcacatgtatgtttatcacagcactatttacaatagcaaagacttggaaccaacccaaatgcccatcaatgatagactggataaagaaaatgtggcacatatacaccgtggaatactatgcagcaataaaaaagaatgaattcatgtcctttgcagggcatggatgaagctggaaaccatcattctcagcagactaacacaggaatagaaaaccaaacactgcatgttctcactcataagtgggagttgaacaatgagaacatatggacacagggagggaacttcacacatcggggcctgtcaggggggtagggggcaaggcaacgtagagcattaggacatatacccaatgcatgcgggcttaaaacctagatgatgggttgatgggtacagcaaaccacaatggcacatgtatacctatgtaacaaacctgcacgttctgcatatgtatcccagaatttaaagtaaaattaaaaaaaatcacacaaaacaaaaaaactgagttcctggccatgatgggatgggagatcagaggccttgttacatcccttccctttggtggttcagacacaacaattggccggcattactgttaaaatagagatcgtaagacaggcagaacagacgctttgtggcaacagggtgccaaattataaacagggcccaaggccattccaggcaagggttaagtcacacatccgtaaacttaaagaatcaactacattttaactgccaggaggttactctttttctctagcagctaaacaagcactggccctgaaataagcaatatggaagcaattgcagctcagccacctccaaacactgactaagccctgctgctccaccagccataactatagctttaattggacaaaacactgatttcagtaactttctccggtaagacgaccaccaactgtggactggatctgggcagtttacagtgggtgcacacttgcctgccttactgtcctgaaaagaccttttgacgtatagggcctaattgtaatacatttaaatgttaagtctccaccccaaactgaacatgggtcatatgttacacgcatgtttattcaatatacatgtgtcaggaccaccctcatgaatatttgtagttcttcctgtaacctgttgaatatgtatgtttagccagcctgttcagcataaagctcccaccccaaccctttctccttcaaagtgtccgtctctgggcttcaaccaaggcctgtgttgcccagccctcggggtggccaccttacaggtggcagctctttacaagaaatagtctcctctccttttccaaactttatgagtgttgttttttttttttgagacagagtctcactctgtcgcccaggctggagtgcagtggcgcgatctccgctcactgcaagctccgcctcccgggttcacgccattctcctgcctcagcctcccccgtagctgggactacaggcgcccgccaccacacccagctgattttttttgtacttttagtggagacggggtttcactgtgttagccaggatggtctcgatctcctgacctcgtgatccacccgcctcggcctcccaaagtgctggcattacaggcgtgagcaccgcgcccggccctgagtttttaaattgttgttaacatttccttctttccttcctttacttccctctcctctttttctttttccctccctcacttcctcattccttcctttttttccttttttctttcttttttgagaagcgccaaactctcctgtaatggtagagaaaaagaggatcacttaggagtttcgatggtttaatttctgggctagttcagatatgtcaatgtttttagtatcaacagtcctaaggacattttgcttttttcaccagaagctgttttttaattaagttaacgttgtctactgtctcactgttgattttcattttttttttttaaatcatgtaagatcttcctgtaagcaacttcagaatatcctcttttcacatttaaggctgcagtaattagacccagatttgctgagcctgtgggaatcctacaaccaaagtgatcttaatggcattttaatgtttgaactcttctgttcttatgtgcgaggttaccaagcagataaaagaagtggctttgacatcctggtgcttattagagtttagaaaatgccctttaagggtgaaaggtttgtgagtttttctttactaaatgagaaacagtgaaaccagcaaacctgtatcagtactcacaatgtattttgcgtttttggtctctttatacttcagatactttgagatattcttgggtaaatacttatgtaagaggattttatgaatgacagcaccttgattttatgaatgacaataccttgtaaatcaggaaacagtaaaaaaaaaaaaaagtgttcaatggtttgtaataggagagattttgtatcttcaaaggaaaggtatgtattttgcaaattaaagacaaggtggtatttggggtttgagaagactttgcatgagattactttataaagccttataaaaacacccagttcacagatgccaattttattggtattacctccatgtgatttatgatagatgatcaaatgaagaaaaagctaaaacagattaaccaaagcatgaaatcattattgtctcaggctgttacctcacttaaattttctccagttttaggggtccaagaactgtcacctggactatcgctggaggatatatcctattccccaaatcctacaaacttcactttcaattcaataataaaattctttgctggttgtttcctttgacccatccaattcttttctaagtgcgagataatttctaagcagagacccactttgttattcttgtagaaccagtccattagctcagtaatatttccctcctgataattacacagcacctgtttatgtcactgcattcatggagcactcattgtgtgcaaagcattatgccaggactgtaggacttcaagatacccaggacagtccttgagttgctgttctcttttggaaagtctgcaaaatgaatcaataagtgatttcaatacaatggtgtgatagcgatgtaacagattcctggggaagctacaagggcagactcacagttgagttgggaccttaaaatgcaggtcttgagtggtgtattagtctgttctcatgctgctaataaagacctacccaagactgggtaatttataaaggaaagaggcttaattgactcactgttccacatggctggggaggcctcacaatcatagcggaaggcgaataaggagcagagtcacatcttatacggcagcaggcgagagagtttgggcaggggaactcctatttataaaaccatcagatctcgtgaggcttattcactaccacgagaacagtatagggaaaactgcacccatgattcaattatctccacctgatcctgcccttgacatgtggggattattataatttaaggtgagagttgggtgaggacgcagccaaaccatatcaactggaaatacgactgcgggtatcagtccacagctgaaggttgagatcaccgatttacctaagagtaggggatagagcaggaggaagagaggtttggggaagctcaacatttactgagtgaatgaaggaagaagaatatcgggaagctccaggaaagaagttgtcagggagatggaggaaggaccagtgttgttccagaatcttcacttcccatcccagatccatccacatggagctgatatgcctctccttactgctgctagttccacct
